United States Patent
Pu et al.

(10) Patent No.: US 12,076,343 B2
(45) Date of Patent: Sep. 3, 2024

(54) ENGINEERED SAFETY IN CELL THERAPY

(71) Applicants: Innovative Cellular Therapeutics Holdings, Ltd., George Town (KY); Innovative Cellular Therapeutics, Inc., Rockville, MD (US)

(72) Inventors: Chengfei Pu, Shanghai (CN); Zhiyuan Cao, Shanghai (CN); Zhao Wu, Shanghai (CN); Lei Xiao, Rockville, MD (US)

(73) Assignees: Innovative Cellular Therapeutics Holdings, Ltd., George Town (KY); Innovative Cellular Therapeutics, Inc., Rockville, MD (US)

( * ) Notice: Subject to any disclaimer, the term of this patent is extended or adjusted under 35 U.S.C. 154(b) by 120 days.

(21) Appl. No.: 17/173,504

(22) Filed: Feb. 11, 2021

(65) Prior Publication Data

US 2021/0252059 A1 Aug. 19, 2021

Related U.S. Application Data

(60) Provisional application No. 63/041,311, filed on Jun. 19, 2020, provisional application No. 62/978,619, filed on Feb. 19, 2020.

(51) Int. Cl.
*A61K 35/17* (2015.01)
*C07K 14/535* (2006.01)
*C07K 14/54* (2006.01)
*C07K 14/55* (2006.01)

(52) U.S. Cl.
CPC ............ *A61K 35/17* (2013.01); *C07K 14/535* (2013.01); *C07K 14/5412* (2013.01); *C07K 14/5418* (2013.01); *C07K 14/5434* (2013.01); *C07K 14/5443* (2013.01); *C07K 14/55* (2013.01)

(58) Field of Classification Search
CPC .......................... A61K 35/17; C07K 2319/00
See application file for complete search history.

(56) References Cited

U.S. PATENT DOCUMENTS

| | | | |
|---|---|---|---|
| 9,388,237 B2 | 7/2016 | Govindan | |
| 9,572,837 B2 | 2/2017 | Wu | |
| 9,932,405 B2 | 4/2018 | Xiao et al. | |
| 10,561,686 B2 | 2/2020 | Xiao et al. | |
| 10,869,888 B2 | 12/2020 | Xiao et al. | |
| 2002/0052027 A1 | 5/2002 | Chen et al. | |
| 2002/0192183 A1 | 12/2002 | Jensen | |
| 2005/0079170 A1 | 4/2005 | Le Gall et al. | |
| 2011/0110936 A1 | 5/2011 | Nam et al. | |
| 2013/0108609 A1 | 5/2013 | Vihko | |
| 2013/0287748 A1 | 10/2013 | June et al. | |
| 2014/0050708 A1 | 2/2014 | Powell et al. | |
| 2014/0227237 A1 | 8/2014 | June et al. | |
| 2014/0271635 A1 | 9/2014 | Brogdon et al. | |
| 2015/0037356 A1 | 2/2015 | Elvin et al. | |
| 2015/0038684 A1 | 2/2015 | Jensen | |
| 2015/0337369 A1 | 11/2015 | Davis et al. | |
| 2016/0024175 A1 | 1/2016 | Chow et al. | |
| 2016/0250258 A1 | 9/2016 | Delaney et al. | |
| 2016/0256488 A1 | 9/2016 | Wu | |
| 2016/0362472 A1 | 12/2016 | Bitter et al. | |
| 2017/0015746 A1 | 1/2017 | Jensen | |
| 2017/0096638 A1 | 4/2017 | Wu | |
| 2017/0136063 A1 | 5/2017 | Perez et al. | |
| 2017/0137783 A1 | 5/2017 | Bedoya et al. | |
| 2017/0145094 A1 | 5/2017 | Galetto | |
| 2017/0145108 A1 | 5/2017 | Schreiber et al. | |
| 2017/0209492 A1 | 7/2017 | June et al. | |
| 2017/0218337 A1 | 8/2017 | Friedman | |
| 2017/0224798 A1 | 8/2017 | Cooper et al. | |
| 2017/0319638 A1 | 11/2017 | Conner et al. | |
| 2017/0335281 A1 | 11/2017 | Loew et al. | |
| 2017/0362325 A1 | 12/2017 | Jung et al. | |
| 2017/0368098 A1 | 12/2017 | Chen et al. | |
| 2018/0028631 A1 | 2/2018 | Chen | |
| 2018/0153977 A1 | 6/2018 | Wu et al. | |
| 2018/0179289 A1 | 6/2018 | Xiao et al. | |
| 2018/0222995 A1 | 8/2018 | Xiao et al. | |
| 2018/0223255 A1 | 8/2018 | Wu et al. | |
| 2018/0230429 A1 | 8/2018 | Baeuerle et al. | |
| 2018/0243340 A1 | 8/2018 | Varadarajan et al. | |
| 2018/0334490 A1 | 11/2018 | Brogdon et al. | |
| 2018/0346876 A1 | 12/2018 | Xiao et al. | |

(Continued)

FOREIGN PATENT DOCUMENTS

EP 2508176 A1 10/2012
JP 2016500659 A1 1/2016

(Continued)

OTHER PUBLICATIONS

Bowie et al. Science, 1990, 247:1306-1310 (Year: 1990).*
Burgess et al. J. Cell Biol. 111:2129-2138, 1990 (Year: 1990).*
Lazar et al. Mol. Cell. Biol., 8:1247-1252, 1988 (Year: 1988).*
Bork. Genome Research, 2000, 10:398-400 (Year: 2000).*
Heppner et al. Cancer Metastasis Review 2:5-23; 1983 (Year: 1983).*
Sporn et al. (Chemoprevention of Cancer, Carcinogenesis, vol. 21 (2000), 525-530 (Year: 2000).*
Auerbach et al. (Cancer and Metastasis Reviews, 2000, 19: 167-172 (Year: 2000).*

(Continued)

*Primary Examiner* — Vanessa L. Ford
*Assistant Examiner* — Sandra Dillahunt
(74) *Attorney, Agent, or Firm* — Lee & Hayes, P.C.

(57) ABSTRACT

The present disclosure relates to compositions and methods for treating cancer. For example, a modified cell may include a polynucleotide comprising an NFAT promoter, a nucleotide sequence encoding therapeutic agent, and a nucleotide sequence encoding a VHL-interaction domain of HIF1α, wherein the therapeutic agent comprises, for example, IL-12, IL-6, and/or IFNγ.

20 Claims, 31 Drawing Sheets

Specification includes a Sequence Listing.

(56) References Cited

U.S. PATENT DOCUMENTS

| | | |
|---|---|---|
| 2019/0000878 A1 | 1/2019 | Xiao et al. |
| 2019/0185817 A1 | 6/2019 | Melton et al. |
| 2019/0216851 A1 | 7/2019 | Xiao et al. |
| 2019/0314410 A1 | 10/2019 | Rossi et al. |
| 2019/0314411 A1 | 10/2019 | Xiao et al. |
| 2020/0155598 A1 | 5/2020 | Xiao et al. |
| 2021/0060069 A1 | 3/2021 | Xiao et al. |
| 2021/0077532 A1 | 3/2021 | Xiao et al. |
| 2021/0100841 A1 | 4/2021 | Xiao et al. |
| 2021/0137983 A1 | 5/2021 | Xiao et al. |
| 2021/0161961 A1 | 6/2021 | Xiao et al. |
| 2021/0230308 A1 | 7/2021 | Xiao et al. |
| 2021/0379149 A1 | 12/2021 | Pu et al. |
| 2022/0000921 A1 | 1/2022 | Xiao et al. |
| 2022/0096546 A1 | 3/2022 | Xiao et al. |
| 2022/0105134 A1 | 4/2022 | Cao et al. |
| 2022/0339193 A1 | 10/2022 | Xiao et al. |
| 2022/0348682 A1 | 11/2022 | Xiao et al. |
| 2023/0312677 A1 | 10/2023 | Posey et al. |

FOREIGN PATENT DOCUMENTS

| | | |
|---|---|---|
| JP | 2018508539 A | 3/2018 |
| JP | 2018518939 A | 7/2018 |
| JP | 2018528774 A | 10/2018 |
| JP | 2021510540 A | 4/2021 |
| JP | 2022507830 A | 1/2022 |
| NO | 168969 B | 1/1992 |
| WO | WO8303679 A1 | 10/1983 |
| WO | WO2008131445 A1 | 10/2008 |
| WO | WO2010081738 A1 | 7/2010 |
| WO | WO2010126766 A1 | 11/2010 |
| WO | WO2012050374 A1 | 4/2012 |
| WO | WO2012066495 A2 | 5/2012 |
| WO | WO2012079000 A1 | 6/2012 |
| WO | WO2013123061 A1 | 8/2013 |
| WO | WO2014011984 A1 | 1/2014 |
| WO | WO2014011988 A2 | 1/2014 |
| WO | WO2015157384 A1 | 10/2015 |
| WO | WO2015157432 A1 | 10/2015 |
| WO | WO2016061574 A1 | 4/2016 |
| WO | WO2016-070136 A1 | 5/2016 |
| WO | WO2016090034 A2 | 6/2016 |
| WO | WO2016090190 A1 | 6/2016 |
| WO | WO2016113203 A1 | 7/2016 |
| WO | WO2016164731 A2 | 10/2016 |
| WO | WO2016174652 A1 | 11/2016 |
| WO | WO2016210293 A1 | 12/2016 |
| WO | WO2017011804 A1 | 1/2017 |
| WO | WO2017027291 A1 | 2/2017 |
| WO | WO2017050884 A1 | 3/2017 |
| WO | WO2017075537 A1 | 5/2017 |
| WO | WO2017120525 A1 | 7/2017 |
| WO | WO2017040324 A1 | 9/2017 |
| WO | WO2017149515 A1 | 9/2017 |
| WO | WO2017167217 A1 | 10/2017 |
| WO | WO2017172952 A1 | 10/2017 |
| WO | WO2017172981 A1 | 10/2017 |
| WO | WO2017173403 A1 | 10/2017 |
| WO | WO2017177137 A1 | 10/2017 |
| WO | WO2017210617 A2 | 12/2017 |
| WO | WO2018013918 A1 | 1/2018 |
| WO | WO2018018958 A1 | 2/2018 |
| WO | WO2018023976 A1 | 2/2018 |
| WO | WO2018027155 A1 | 2/2018 |
| WO | WO2018049418 A1 | 3/2018 |
| WO | WO2018067697 A1 | 4/2018 |
| WO | WO2018106732 A1 | 6/2018 |
| WO | WO2018111763 A1 | 6/2018 |
| WO | WO2019091478 A1 | 5/2019 |
| WO | WO2019136305 A1 | 7/2019 |
| WO | WO2019140100 A1 | 7/2019 |
| WO | WO2019178576 A1 | 9/2019 |
| WO | WO2020086742 A1 | 4/2020 |
| WO | WO2020086989 A1 | 4/2020 |
| WO | WO2020106843 A1 | 5/2020 |
| WO | WO2020146743 A1 | 7/2020 |

OTHER PUBLICATIONS

Gura T (Science, 1997, 278(5340): 1041-1042 (Year: 1997).*
Jain RK (Scientific American, Jul. 1994,58-65 (Year: 1994).*
Hait. Nature Reviews/Drug Discovery, 2010, 9, pp. 253-254 (Year: 2010).*
Gravanis et al (Chin Clin Oncol, 2014, 3, pp. 1-5 (Year: 2014).*
Beans. PNAS 2018; 115(50): 12539-12543 (Year: 2018).*
Brischwein et al. "Strictly target cell-dependent activation of T cells by bispecific single-chain antibody constructs of the BiTE class" J Immunother, Nov. 2007, vol. 30, pp. 798-807. entire document.
Chmielewski, "Of CARs and TRUCKs: Chimeric antigen receptor (CAR) T Cells Engineered with an Inducible Cytokine to Modulate the Tumor Stroma," Jan. 2014. Imunological Reviews, 257(1): 83-90.
European Search Report mailed Aug. 31, 2021 in European Application No. 21275039.2, a foreign corresponding application of U.S. Appl. No. 16/999,357, 13 pages.
Huang et al., "Interleukin-armed Chimeric Antigen Receptor-modified T Cells for Cancer Immunotherapy," Sep. 2017. Gene Thereapy, 25(3):192-197.
International Search Report & Written Opinion mailed Aug. 13, 2021 from PCT Application No. PCT/2021/028429, 12 pages.
International Preliminary Report on Patentability dated Jul. 22, 2021 in PCT Application No. PCT/US2020/013099, 9 pages.
Lee et al., "Use of a Single CAR T Cell and Several Bispecific Adapters Facilitates Eradication of Multiple Antigenically Different Solid Tumors," Nov. 2018. Cancer Research, 79(2): 387-396.
Wong et al. "Blinatumomab induces autologous T-cell killing of chronic lymphocytic leukemia cells," Jun. 2013, Haematologica, vol. 98(12): 1930-1938.
European Office Action mailed Mar. 17, 2022 for European Patent Application No. 19700326.2, a foreign counterpart to U.S. Pat. No. 10,561,686, 7 pages.
Partial European Search Report mailed May 4, 2022 for European Patent Application No. 19854895.0, 13 pages.
Japanese office action mailed Apr. 5, 2022 in Japanese Application No. 2021-512204, a foreign corresponding application of U.S. Appl. No. 17/220,387, 10 pages. Translated.
Marks et al., "By-passing Immunization: Human Antibodies from V-gene Libraries Displayed on Phage" 1991. Journal of Molecular Biology, 222(3): 581-597.
Canadian Office Action for Canadian Patent Appl.: 3,088,161, mailed Sep. 22, 2021, a foreign corresponding application of U.S. Appl. No. 16/999,357, 4 pages.
U.S. Appl. No. 16/146,218, filed Sep. 28, 2018, US-2019-0216851-A1, U.S. Pat. No. 10,561,686, Granted.
U.S. Appl. No. 16/961,418, filed Jul. 10, 2020, Pending.
U.S. Appl. No. 16/445,965, filed Jun. 19, 2019, US-2020-0155598-A1, U.S. Pat. No. 10,918,667, Granted.
U.S. Appl. No. 17/144,800, filed Jan. 8, 2021, US 2021-0161961 A1, Pending.
U.S. Appl. No. 17/295,364, filed May 19, 2021, Pending.
U.S. Appl. No. 16/387,166, filed Apr. 17, 2019, US 2019-0314411 A1, U.S. Pat. No. 10,869,888, Granted.
U.S. Appl. No. 17/091,741, filed Nov. 6, 2020, US 2021-0137983 A1, Pending.
U.S. Appl. No. 17/108,076, filed Dec. 1, 2020, US 2021-0077532 A1, Pending.
U.S. Appl. No. 17/420,066, filed Jun. 30, 2021, Pending.
U.S. Appl. No. 17/270,571, filed Feb. 23, 2021, Pending.
U.S. Appl. No. 17/220,387, filed Apr. 1, 2021, Pending.
U.S. Appl. No. 17/123,732, filed Dec. 16, 2020, Pending.
U.S. Appl. No. 17/173,504, filed Feb. 11, 2021, Pending.
U.S. Appl. No. 16/996,237, filed Aug. 18, 2020, US 2021-0060069 A1, Pending.
U.S. Appl. No. 17/331,289, filed May 26, 2021, Pending.

(56) References Cited

OTHER PUBLICATIONS

U.S. Appl. No. 16/999,357, filed Aug. 21, 2020, US 2021-0100841 A, Pending.
Canadian Office Action mailed Sep. 1, 2023 for Canadian Patent Application No. 3,125,646, a foreign counterpart to U.S. Pat. No. 10,869,888, 4 pages.
Cherkassky et al., "Human CAR T Cells with Cell-intrinsic PD-1 Checkpoint Blockade Resist Tumor-mediated Inhibition," Journal of Clinical Investigation, May 2016, 126(8):3130-3144.
Chmielewski et al., "CAR T Cells Releasing IL-18 Convert to T-Bethigh FoxO1low Effectors that Exhibit Augmented Activity Against Solid Tumors," Cell Reports, Dec. 2017, 21:3205-3219.
Eyquem et al., "Targeting a CAR to the TRAC Locus with CRISPR/Cas9 Enhances Tumour Rejection," Nature, Mar. 2017, 543:113-117.
Grada et al., "TanCar: A Novel Bispecific Chimeric Antigen Receptor for Cancer Immunotherapy," Molecular Therapy—Nucleic Acids, Jul. 2013, vol. 2:e105, 11 pages.
Liu et al., "A Chimeric Switch-receptor Targeting PD1 Augments the Efficacy of Second-Generation CAR T Cells in Advanced Solid Tumors," Cancer Research, Mar. 2016, 76(6):1578-1590.
Magee et al., "GUCY2C-directed CAR-T Cells Oppose Colorectal Cancer Metastases Without Autoimmunity," OncoImmunology, Oct. 2016, 5(1):e1227897, 11 pages.
Roybal et al., "Engineering T cells with Customized Therapeutic Response Programs Using Synthetic Notch Receptors," Cell, Oct. 2016, 167:419-432.
Bollino et al., "Chimeric Antigen Receptor-Engineered Natural Killer and Natural Killer T cells for Cancer Immunotherapy," Translational Research, Jun. 2017, 187:32-43.
Duong et al., "Bacteria-cancer Interactions: Bacteria-based Cancer Therapy," Experimental & Molecular Medicine, 2019, 51:152, 15 pages.
Fang et al., "NK Cell-based Immunotherapy for Cancer," Seminars in Immunology, Aug. 2017, 31:37-54.
Japanese Office Action mailed May 30, 2023 for Japanese Patent Application No. 2020-558861, a foreign counterpart to U.S. Pat. No. 10,561,686, 7 pages.
Mirzaei et al., "Chimeric Antigen Receptors T Cell Therapy in Solid Tumor: Challenges and Clinical Applications," Fronteirs in Immunology, Dec. 2017, 8:1850, 13 pages.
Sarvaria et al., "B cell Regulation in Cancer and Anti-Tumor Immunity", Cellular and Molecular Immunology, Apr. 2017, 14:662-674.
Singapore Office action mailed Feb. 28, 2023, in Singapore Application No. 11202107269X, a corresponding foreign application of U.S Appl. No. 16/387,166, 12 pages.
Turtle et al., "Immunotherapy of Non-Hodgkin's Lymphoma with a Defined Ratio of CD8+ and CD4+ CD19-specific Chimeric Antigen Receptor-modified T cells," Science Translational Medicine, Sep. 2016, 8:355, 29 pages.
Zhou et al., "The use of tMUC1 Highly Specific Chimeric Antigen Receptor-redirected T cells for the Eradication of Triple Negative Breast Cancer," J Immunol, May 2017, 198:(1 Supplement):198.10, 2 pages, Abstract.
Almagro et al., "Progress and challenges in the design and clinical development of antibodies for cancer therapy," Frontiers in Immunology, Jan. 2018, 8:1751, 19 pages.
Breloer et al., "CD83 Regulates Lymphocyte Maturation, Activation and Homeostasis," Trends in Immunology, Mar. 2008, 29(4):186-194.
Brown et al., "Tolerance of Single, But Not Multiple, Amino Acid Replacements in Antibody VH CDR 2: A Means of Minimizing B Cell Wastage from Somatic Hypermutation?" Journal of Immunology, May 1996, 156(9):3285-3291.
Brudno et al., "Toxicities of Chimeric Antigen Receptor T Cells: Recognition and Management," Blood, Jun. 2016, 127(26):3321-3330.
Cho et al., "Triple Costimulation Via CD80, 4-1 BB, and CD83 Ligand Elicits the Long-Term Growth of Vγ9Vδ2 T Cells in Low Levels of IL-2," Journal of Leukocyte Biology, Apr. 2016, 99(4):521-529.
Du et al., "Granulocyte Colony-Stimulating Factor Treatment During Radiotherapy Is Associated With Survival Benefit in Patients With Lung Cancer," Technology in Cancer Research & Treatment, Dec. 2018, 17:1-7.
European Office Action mailed Feb. 5, 2024 for European Application No. 19854895.0, a foreign counterpart to U.S. Appl. No. 17/270,571, 6 pages.
Japanese Office Action mailed Jan. 30, 2024 for Japanese Application No. 2021-540137, a foreign counterpart to U.S. Appl. No. 17/420,066, 7 pages.
Konjevic et al., "The Role of Cytokines in the Regulation of NK Cells in the Tumor Environment," Cytokine, May 2019, 117:30-40.
Li et al., "CD83: Activation Marker for Antigen Presenting Cells and Its Therapeutic Potential," Frontiers in Immunology, Jun. 2019, 10:Article 1312, 9 pages.
Ping et al., "T-cell Receptor-engineered T Cells for Cancer Treatment: Current Status and Future Directions," Protein Cell, Mar. 2018, 9(3):254-266.
Priceman et al., "Co-stimulatory Signaling Determines Tumor Antigen Sensitivity and Persistence of CART Cells Targeting PSCA + Metastatic Prostate Cancer," OncoImmunology, Feb. 2018, 7(2):e1380764, 13 pages.
Rabinowich et al,. "Response of Human NK Cells to IL-6 Alterations of the Cell Surface Phenotype, Adhesion to Fibronectin and Laminin, and Tumor Necrosis Factor-Alpha/Beta Secretion," Journal of immunology, Jun. 1993, 150(11):4844-4855.
Scheuermann et al., "CD19 Antigen in Leukemia and Lymphoma Diagnosis and Immunotherapy," Leukemia & Lymphoma, 1995, 18(5-6):385-397.
Su et al., "Interleukin-7 Expression and its Effect on Natural Killer Cells in Patients with Multiple Sclerosis," J Neuroimmunol., Nov. 2014, 276(0):180-186.
Zhang et al., "The Emerging World of TCR-T Cell Trials Against Cancer: A Systematic Review," Technology in Cancer Research & Treatment, Jul. 2019, 18:1-13.
Altuntas et al., "Autoimmunity to Uroplakin II Causes Cystitis in Mice: A Novel Model of Interstitial Cystitis," Eur Urol, Jan. 2012, 61(1):193-200.
Canadian Office Action mailed Sep. 14, 2023 for Canadian Application No. 3120153, a foreign corresponding application of U.S. Appl. No. 17/295,364, 4 pages.
Canadian Office Action mailed Sep. 19, 2023 for Canadian Application No. 3110096, a foreign corresponding application of U.S. Appl. No. 17/270,571, 3 pages.
Hoang et al., "A Newly Developed Uroplakin II Antibody With Increased Sensitivity in Urothelial Carcinoma of the Bladder," Arch Pathol Lab Med, Jul. 2014, 138:943-949.
Japanese Office Action mailed Oct. 17, 2023 for Japanese Application No. 2021-527959, a foreign corresponding application of U.S. Appl. No. 17/295,364, 6 pages.
Japanese Office Action mailed Oct. 31, 2023 for Japanese Application No. 2022-154638, aa foreign corresponding application of U.S. Appl. No. 17/270,571, 6 pages.
Liou et al., "Macrophage-secreted Cytokines Drive Pancreatic Acinar-to-ductal Metaplasia Through NF-KB and MMPs," Journal of Cell Biology, 2013, 202(3):563-577.
Mishu et al., "Effects of Recombinant Canine Granulocyte Colony-stimulating Factor on White Blood Cell Production in Clinically Normal and Neutropenic Dogs," J Am Vet Med Assoc., Jun. 1992, 200(12), Abstract, 1 page.
Rahman et al., "Histology, Natural Killer Cells," retrieved from <<https://www.ncbi.nlm.nih.gov/books/NBK565844/>>, StatPearls Publishing, Feb. 2023, 6 pages.
Rohaan et al., "Adoptive Cellular Therapies: The Current Landscape," Virchows Archiv, Nov. 2018, 474:449-461.
Snook et al., "GUCY2C-targeted Cancer Immunotherapy: Past, Present and Future," Immunology Research, Dec. 2011, 51:161-169.

(56) References Cited

OTHER PUBLICATIONS

Tigner et al., "Histology, White Blood Cell," retrieved from <<https://www.ncbi.nlm.nih.gov/books/NBK563148/>>, StatPearls Publishing, Nov. 2022, 5 pages.
Wu et al., "Potentiating Antilymphoma Efficacy of Chemotherapy Using a Liposome for Integration of CD20 Targeting, Ultra-violet Irradiation Polymerizing, and Controlled Drug Delivery", Nanoscale Research Letters, 2014, 9(447), 11 pages.
Yu et al., "CART Cell Therapy for Prostate Cancer: Status and Promise," OncoTargets and Therapy, 2019, 12:391-395.
Canadian Office Action mailed Oct. 25, 2023 for Canadian Application No. 3,088,161, a foreign counterpart to U.S. Pat. No. 10,561,686, 4 pages.
Japanese Office Action mailed Jan. 16, 2024 for Japanese Application No. 2020-558861, a foreign counterpart to U.S. Pat. No. 10,561,686, 7 pages.
Canadian Office Action mailed Jul. 20, 2022 for Canadian Patent Application No. 3,088, 161, a foreign counterpart to U.S. Pat. No. 10,561,686, 4 pages.
Chmielewski, et al., "IL-12 Release by Engineered T Cells Expressing Chimeric Antigen Receptors Can Effectively Muster and Antigen-Independent Macrophage Response on Tumor Cells That Have Shut Down Tumor Antigen Expression", Cancer Research, Jul. 2011, 71(17):5697-5706.
Extended European Search Report mailed Nov. 14, 2022 for European Patent Application No. 19887928.0, a foreign corresponding application of U.S. Appl. No. 16/445,965, 12 pages.
Extended European Search Report mailed Nov. 24, 2022 for European Patent Application No. 20739064.2, a foreign corresponding application of U.S. Appl. No. 16/387,166, 13 pages.
European Search Report mailed Aug. 4, 2022 in European Application No. 19854895.0, a foreign corresponding application of U.S. Appl. No. 17/270,571, 8 pages.
Hoyos, et al., "Engineering CD19-specific T lymphocytes with interleukin-15 and a suicide gene to enhance their anti-lymphoma/leukemia effects and safety", Leukemia, Apr. 2010, 24(6):1160-1170.
Japanese Office Action mailed Sep. 20, 2022 for Japanese Patent Application No. 2020-558861, a foreign counterpart to U.S. Pat. No. 10,561,686, 7 pages.
Klaver, et al., "Plasma IFN-[gamma] and IL-6 levels correlate with peripheral T-cell Nos. but not toxicity in RCC patients treated with CAR T-cells", Clinical Immunology, Jul. 2016, 169:107-113.
Koneru, et al., "IL-12 Secreting tumor-targeted chimeric antigen receptor T cells eradicate ovarian tumors in vivo", Oncoimmunology, Jan. 2015, 4(3):e994446, 11 pages.
Posey et al., "Engineered Car T Cells Targeting the Cancer-Associated Tn-Glycoform of the Membrane Mucin MUC1 Control Adenocarcinoma", Immunity, Jun. 2016, 44(6):1444-1454.
Leon-Triana, et al., "Dual-Target CAR-Ts with On- and Off-Tumor Activity May Override Immune Suppression in Solid Cancers: A Mathematical Proof of Concept", Cancers, Feb. 2021, 13(4):703, 20 pages.
Trinchieri, "Interleukin-12 and the regulation of innate resistance and adaptive immunity", Nature Reviews Immunology. Feb. 2003, 3(2):133-146.
Ghadially, et al., "Differential Regulation of CCL22 Gene Expression in Murine Dendritic Cells and B Cells", The Journal of Immunology, May 2009, 174(9):5620-5629.
Kim, et al., "Increased IL-12 inhibits B cells' differentiation to germinal center cells and promotes differentiation to short-lived plasmablasts", The Journal of Experimental Medicine, Sep. 2008, 205(10):2437-2448.
Argeot, et al., "The B-Side of Cancer Immunity: The Underrated Tune", Cells, May 2019, 8(449):1-20.
"Anti-ACPP Product Datasheet", Atlas Antibodies, retrieved on Oct. 31, 2019 from https://www.atlasantibodies.com/api/print_datasheet/HPA004335.pdf, Dec. 2012 1 page.

"Anti-UPK2 Product Datasheet", Atlas Antibodies, retrieved on Oct. 31, 2019 from https://www.atlasantibodies.com/api/print_datasheet/HPA061106.pdf, Dec. 2012, 1 page.
Invitation to Pay Additional Fees mailed on Nov. 13, 2019 for PCT Application PCT/US19/48890, 3 Pages.
International Preliminary Report on Patentability mailed Mar. 11, 2021 for PCT Application No. PCT/US19/48890, 8 pages.
International Search Report and Written Opinion mailed on Feb. 7, 2020 for PCT Application No. PCT/US19/48890, 15 pages.
Chen, et al., "CAR T-cell intrinsic PD-1 checkpoint blockade: a two-in-one approach for solid tumor immunotherapy," Feb. 2017, Oncolmmunology, 6:2, e1273302, DOI: 10.1080/2162402X.2016. 1273302. 4 pages.
Extended European Search Report mailed Nov. 25, 2019 in EP Application No. 19180127.3, Xiao et al., a corresponding foreign application of U.S. Appl. No. 16/146,218, 11 pages.
Fang et al., "Stable antibody expression at therapeutic levels using the 2A peptide," May 2005, Nature Biotechnology. 23(5):584-590.
PCT Communication Invitation to Pay Fees mailed Mar. 30, 2020 for PCT Application No. PCT/US20/13099, "Modified Cell Expansion and Uses Thereof", 2 pages.
Jernberg-Wiklund, et al., "Recombinant interferon-gamma inhibits the growth of IL-6-dependent human multiple myeloma cell lines in vitro," 1991. Eur J Haematol, 46:231.239.
Lee et al., "T cells expressing CD19 chimeric antigen receptors for acute lymphoblastic leukemia in children and young adults: a phase 1 dose-escalation trial," Oct. 2014. The Lancet, 385(9967): 517-528.
Maude et al., "Chimeric antigen receptor T cells for sustained remissions in leukemia," Octonber 2014. N Engl J Med. 371(16): 1507-1517.
Milone, et al., "Chimeric receptors containing CD137 signal transduction domains mediate enhanced survival of T cells and increased antileukemic efficacy in vivo," Apr. 2009. Molecular Therapy, 17(8): 1453-1464.
Partial European Search Report mailed Nov. 4, 2019 in EP Application No. 19180127.3, Xiao et al., a corresponding foreign application of U.S. Appl. No. 16/146,218, 18 pages.
PCT Search Report and Written Opinion mailed on Jun. 17, 2019 for PCT Application No. PCT/US19/13068, 14 pages.
PCT Search Report and Written Opinion mailed on Feb. 20, 2020 for PCT Application No. PCT/US19/62417, 14 pages.
The PCT Search Report and Written Opinion mailed on Jun. 4, 2020 for PCT Application No. PCT/US2020/013099, 13 pages.
Qin et al., "Incorporation of a hinge domain improves the expansion of chimeric antigen receptor T cells," 2017, Journal of Hematology & Oncology, 10:68, 11 pages.
Sahm et al., "Expression of IL-15 in NK Cells Results in Rapid Enrichment and Selective Cytotoxicity of Gene-Modified Effectors That Carry a Tumor-Specific Antigen Receptor," Sep. 2012, Cancer Immunol Immunother, 61(9): 1451-1461.
Supplemental European Search Report mailed Jan. 13, 2020 in EP Application No. 19700326, Xiao et al., a corresponding foreign application of U.S. Appl. No. 16/146,218, 7 pages.
Takahashi, et al., "Expression of MUC1 on myeloma cells and induction of HJLA-unrestricted CTL against MUC1 from a multiple myeloma patient," 1994. J Immunol, 153:2102-2109.
Wilkie, et al. "Retargeting of human T cells to tumor-associated MUC1: The evolution of a chimeric antigen receptor," 2008, J. Immunol., 180:4901-4909.
Xiao et al., "Pre-clinical experiments of cart cells identifying tshr as a potential target against metastatic thyroid cancer," May 2018. Database EMBASE [Online] Elsevier Science Publishers, Database Accession No. EMB-623339571, 1 page.
You et al., "Phase 1 clinical trial demonstrated that MUC1 positive metastatic seminal vesicle cancer can be effectively eradicated y modified Anti-MUC1 chimeric antigen receptor transduced T cells", Apr. 2016, Science China: Life Sciences, 59(4): 386-397.
Rizzardi, et al., "Evaluation of Protein Biomarkers of Prostate Cancer Aggressiveness," Dec. 2014. BMC Cancer, 14(1): 14 pgs.
Office Action for European Application No. 21275039.2, Dated May 23, 2024, 7 pages.

(56) References Cited

OTHER PUBLICATIONS

Office Action for Japanese Application No. 2021-527959, Dated May 7, 2024, 6 pages.
Kim, et al., "High Cleavage Efficiency of a 2A Peptide Derived from Porcine Teschovirus-1 in Human Cell Lines, Zebrafish and Mice", PLOS One, vol. 6, issue 4, Apr. 29, 2011, pp. 1-8.

* cited by examiner

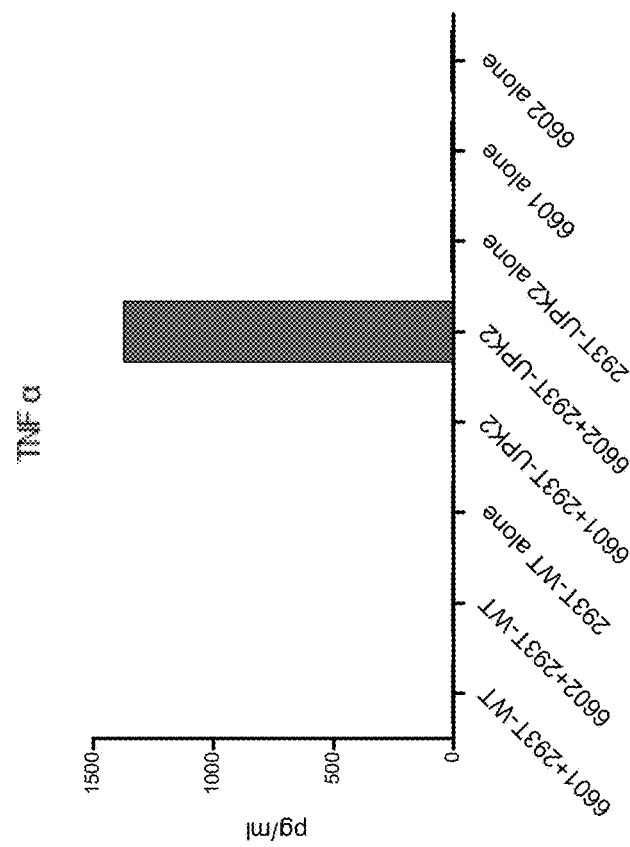
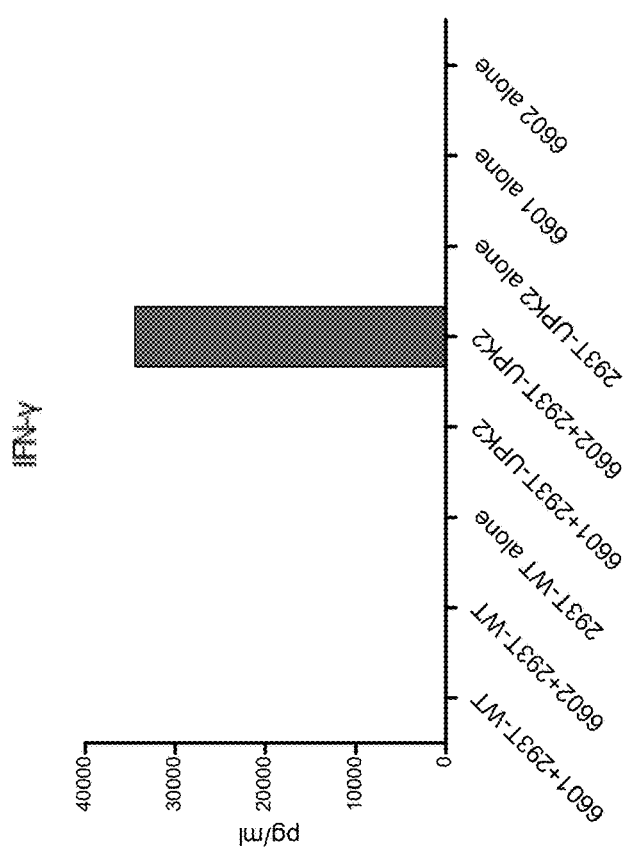
FIG. 18

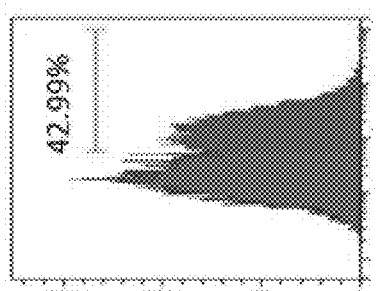
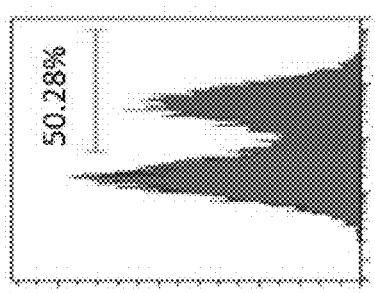
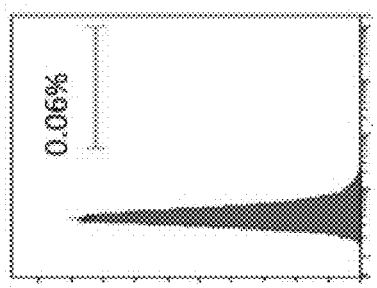
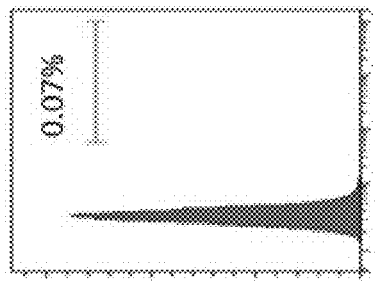
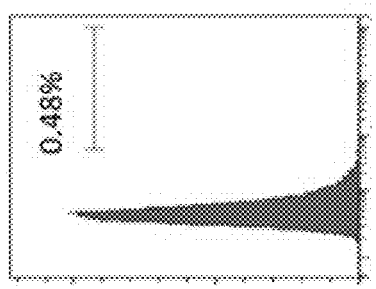
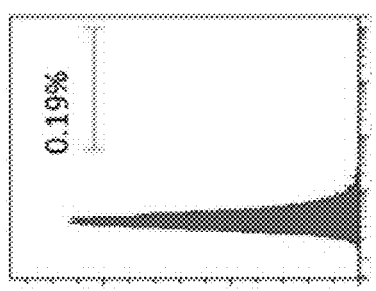
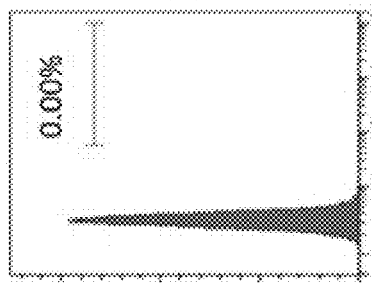
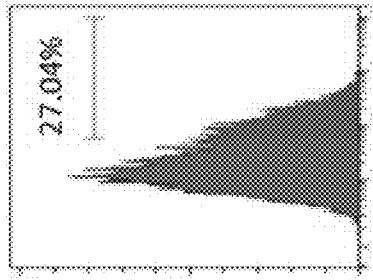
FIG. 19

| 15 Combinations | Vectors | | | | CAR+ cell | |
| --- | --- | --- | --- | --- | --- | --- |
| | | | | | Cell # | Cell % |
| 1 vector | GUCY2C-CAR | | | | 1210 | 18.92% |
| | IFNg-CD19-CAR | | | | 144 | 2.25% |
| | IL6-CD19-CAR | | | | 7 | 0.11% |
| | IL12-CD19-CAR | | | | 9 | 0.14% |
| 2 Vectors | GUCY2C-CAR | IFNg-CD19-CAR | | | 93 | 1.45% |
| | GUCY2C-CAR | IL6-CD19-CAR | | | 3 | 0.05% |
| | GUCY2C-CAR | IL12-CD19-CAR | | | 4 | 0.06% |
| | IFNg-CD19-CAR | IL6-CD19-CAR | | | 3 | 0.05% |
| | IFNg-CD19-CAR | IL12-CD19-CAR | | | 2 | 0.03% |
| | IL6-CD19-CAR | IL12-CD19-CAR | | | 0 | 0.00% |
| 3 Vectors | GUCY2C-CAR | IFNg-CD19-CAR | IL6-CD19-CAR | | 2 | 0.03% |
| | GUCY2C-CAR | IFNg-CD19-CAR | IL12-CD19-CAR | | 1 | 0.02% |
| | GUCY2C-CAR | IL6-CD19-CAR | IL12-CD19-CAR | | 0 | 0.00% |
| | IFNg-CD19-CAR | IL6-CD19-CAR | IL12-CD19-CAR | | 1 | 0.02% |
| 4 Vectors | GUCY2C-CAR | IFNg-CD19-CAR | IL6-CD19-CAR | IL12-CD19-CAR | 1 | 0.02% |
| No Cytokines | GUCY2C-CAR | | | | 247 | 3.86% |
| | CD19-CAR | | | | 207 | 3.24% |

FIG. 28

| 15 Combinations | Vectors | | | | CAR+ cell | |
|---|---|---|---|---|---|---|
| | | | | | Cell # | Cell % |
| 1 vector | GUCY2C-CAR | | | | 1321 | 21.07% |
| | IFNg-CD19-CAR | | | | 357 | 5.69% |
| | IL6-CD19-CAR | | | | 5 | 0.08% |
| | IL12-CD19-CAR | | | | 24 | 0.38% |
| 2 Vectors | GUCY2C-CAR | IFNg-CD19-CAR | | | 519 | 8.28% |
| | GUCY2C-CAR | IL6-CD19-CAR | | | 11 | 0.18% |
| | GUCY2C-CAR | IL12-CD19-CAR | | | 33 | 0.53% |
| | IFNg-CD19-CAR | IL6-CD19-CAR | | | 9 | 0.14% |
| | IFNg-CD19-CAR | IL12-CD19-CAR | | | 2 | 0.03% |
| | IL6-CD19-CAR | IL12-CD19-CAR | | | 0 | 0.00% |
| 3 Vectors | GUCY2C-CAR | IFNg-CD19-CAR | IL6-CD19-CAR | | 18 | 0.29% |
| | GUCY2C-CAR | IFNg-CD19-CAR | IL12-CD19-CAR | | 15 | 0.24% |
| | GUCY2C-CAR | IL6-CD19-CAR | IL12-CD19-CAR | | 1 | 0.02% |
| | IFNg-CD19-CAR | IL6-CD19-CAR | IL12-CD19-CAR | | 3 | 0.05% |
| 4 Vectors | GUCY2C-CAR | IFNg-CD19-CAR | IL6-CD19-CAR | IL12-CD19-CAR | 10 | 0.16% |
| No Cytokines | GUCY2C-CAR | | | | 297 | 4.74% |
| | CD19-CAR | | | | 241 | 3.84% |

FIG. 29

ENGINEERED SAFETY IN CELL THERAPY

CROSS REFERENCE TO RELATED APPLICATIONS

This application claims the benefit of U.S. Provisional Application 62/978,619, filed Feb. 19, 2020; and U.S. Provisional Application 63/041,311, filed Jun. 19, 2020, both of which are hereby incorporated by reference in their entirety.

SEQUENCE LISTING INFORMATION

A computer readable textfile, entitled "93SL_ST25.txt," created on or about Jan. 21, 2021, with a file size of about 1.3 MB, contains the sequence listing for this application and is hereby incorporated by reference in its entirety.

BACKGROUND

Cancer involves abnormal cell growth with the potential to invade or spread to other parts of the body. Once cancer cells are exfoliated, they spread over the entire body via the blood and/or lymph systems and therefore become life-threatening. While T cell therapy achieves strong antitumor activities against blood tumor, it is facing challenges for treating solid tumor.

BRIEF DESCRIPTION OF THE DRAWINGS

The Detailed Description is described with reference to the accompanying figures. The use of the same reference numbers in different figures indicates similar or identical items.

FIG. 18 shows cytokines released by UPK2 CAR T cells co-cultured with UPK2 positive cells.

FIG. 19 shows transduction of UPK2 antigen on 293T cells transiently.

FIG. 28 shows cell numbers and percentages of different subsets of non-activated T cells that were introduced with various vectors.

FIG. 29 shows cell numbers and percentages of different subsets of activated T cells that were introduced with various vectors.

DETAILED DESCRIPTION

Figure 1:
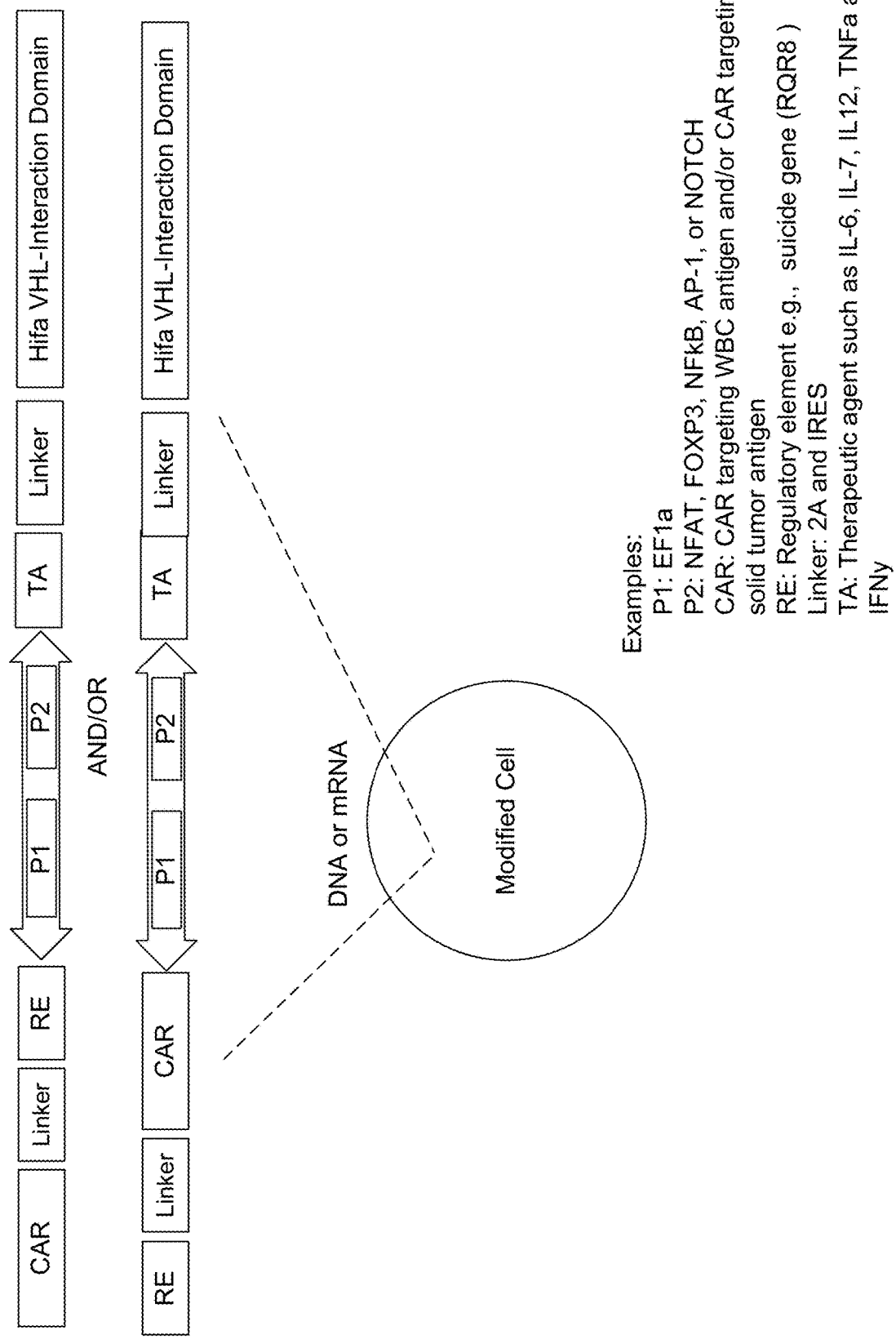
FIG. 1 is a schematic diagram of exemplary modified cells.

Unless defined otherwise, all technical and scientific terms used herein have the same meaning as commonly understood by those of ordinary skill in the art to which the disclosure belongs. Although any method and material similar or equivalent to those described herein can be used in the practice or testing of the present disclosure, preferred methods and materials are described. For the purposes of the present disclosure, the following terms are defined below.

The articles "a" and "an" are used herein to refer to one or to more than one (i.e., to at least one) of the grammatical object of the article. By way of example, "an element" means one element or more than one element.

By "about" is meant a quantity, level, value, number, frequency, percentage, dimension, size, amount, weight, or length that varies by as much as 20, 15, 10, 9, 8, 7, 6, 5, 4, 3, 2 or 1% to a reference quantity, level, value, number, frequency, percentage, dimension, size, amount, weight or length.

The term "activation," as used herein, refers to the state of a cell that has been sufficiently stimulated to induce detectable cellular proliferation. Activation can also be associated with induced cytokine production and detectable effector functions. The term "activated T cells" refers to, among other things, T cells that are undergoing cell division.

The term "antibody" is used in the broadest sense and refers to monoclonal antibodies (including full length monoclonal antibodies), polyclonal antibodies, multi-specific antibodies (e.g., bispecific antibodies), and antibody fragments so long as they exhibit the desired biological activity or function. The antibodies in the present disclosure may exist in a variety of forms including, for example, polyclonal antibodies; monoclonal antibodies; Fv, Fab, Fab', and F(ab')$_2$ fragments; as well as single chain antibodies and humanized antibodies (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, New York; Houston et al., 1988, Proc. Natl. Acad. Sci. USA 85:5879-5883; Bird et al., 1988, Science 242:423-426).

The term "antibody fragments" refers to a portion of a full-length antibody, for example, the antigen binding or variable region of the antibody. Other examples of antibody fragments include Fab, Fab', F(ab')$_2$, and Fv fragments; diabodies; linear antibodies; single-chain antibody molecules; and multi-specific antibodies formed from antibody fragments.

The term "Fv" refers to the minimum antibody fragment which contains a complete antigen-recognition and -binding site. This fragment consists of a dimer of one heavy- and one light-chain variable region domain in a tight, non-covalent association. From the folding of these two domains emanates six hypervariable loops (3 loops each from the H and L chain) that contribute amino acid residues for antigen binding and confer antigen binding specificity to the antibody. However, even a single variable domain (or half of an Fv including only three complementarity determining regions (CDRs) specific for an antigen) has the ability to recognize and bind antigen, although at a lower affinity than the entire binding site (the dimer).

An "antibody heavy chain," as used herein, refers to the larger of the two types of polypeptide chains present in all antibody molecules in their naturally occurring conformations. An "antibody light chain," as used herein, refers to the smaller of the two types of polypeptide chains present in all antibody molecules in their naturally occurring conformations. K and A light chains refer to the two major antibody light chain isotypes.

The term "synthetic antibody" refers to an antibody that is generated using recombinant DNA technology, such as, for example, an antibody expressed by a bacteriophage. The term also includes an antibody that has been generated by the synthesis of a DNA molecule encoding the antibody and the expression of the DNA molecule to obtain the antibody or to obtain an amino acid encoding the antibody. The synthetic DNA is obtained using technology that is available and well known in the art.

The term "antigen" refers to a molecule that provokes an immune response, which may involve either antibody production, or the activation of specific immunologically-competent cells, or both. Antigens include any macromolecule, including all proteins or peptides or molecules derived from recombinant or genomic DNA. For example, DNA including a nucleotide sequence or a partial nucleotide sequence encoding a protein or peptide that elicits an immune response, and therefore, encodes an "antigen," as the term is used herein. An antigen need not be encoded solely by a full-length nucleotide sequence of a gene. An antigen can be generated, synthesized, or derived from a biological sample including a tissue sample, a tumor sample, a cell, or a biological fluid.

The term "anti-tumor effect," as used herein, refers to a biological effect associated with a decrease in tumor volume, a decrease in the number of tumor cells, a decrease in the number of metastases, decrease in tumor cell proliferation, decrease in tumor cell survival, an increase in life expectancy of a subject having tumor cells, or amelioration of various physiological symptoms associated with the cancerous condition. An "anti-tumor effect" can also be manifested by the ability of the peptides, polynucleotides, cells, and antibodies in the prevention of the occurrence of tumor in the first place.

The term "auto-antigen" refers to an endogenous antigen mistakenly recognized by the immune system as being foreign. Auto-antigens include cellular proteins, phosphoproteins, cellular surface proteins, cellular lipids, nucleic acids, glycoproteins, including cell surface receptors.

The term "autologous" is used to describe a material derived from a subject, which is subsequently re-introduced into the same subject.

The term "allogeneic" is used to describe a graft derived from a different subject of the same species. As an example, a donor subject may be related or unrelated to the recipient subject, but the donor subject has immune system markers that are similar to the recipient subject.

The term "xenogeneic" is used to describe a graft derived from a subject of a different species. As an example, the donor subject is from a different species than a recipient subject, and the donor subject and the recipient subject can be genetically and immunologically incompatible.

The term "cancer" is used to refer to a disease characterized by the rapid and uncontrolled growth of aberrant cells. Cancer cells can spread locally or through the bloodstream and lymphatic system to other parts of the body. Examples of various cancers include breast cancer, prostate cancer, ovarian cancer, cervical cancer, skin cancer, pancreatic cancer, colorectal cancer, renal cancer, liver cancer, brain cancer, lymphoma, leukemia, lung cancer, and the like.

Throughout this specification, unless the context requires otherwise, the words "comprise," "includes," and "including" will be understood to imply the inclusion of a stated step or element or group of steps or elements but not the exclusion of any other step or element or group of steps or elements.

The phrase "consisting of" is meant to include, and is limited to, whatever follows the phrase "consisting of." Thus, the phrase "consisting of" indicates that the listed elements are required or mandatory and that no other elements may be present.

The phrase "consisting essentially of" is meant to include any element listed after the phrase and can include other elements that do not interfere with or contribute to the activity or action specified in the disclosure for the listed elements. Thus, the phrase "consisting essentially of" indicates that the listed elements are required or mandatory, but those other elements are optional and may or may not be present depending upon whether or not they affect the activity or action of the listed elements.

The terms "complementary" and "complementarity" refer to polynucleotides (i.e., a sequence of nucleotides) related by the base-pairing rules. For example, the sequence "A-G-T" is complementary to the sequence "T-C-A." Complementarity may be "partial," in which only some of the nucleic acids' bases are matched according to the base-pairing rules, or there may be "complete" or "total" complementarity between the nucleic acids. The degree of complementarity between nucleic acid strands has significant effects on the efficiency and strength of hybridization between nucleic acid strands.

The term "corresponds to" or "corresponding to" refers to (a) a polynucleotide having a nucleotide sequence that is substantially identical or complementary to all or a portion of a reference polynucleotide sequence or encoding an amino acid sequence identical to an amino acid sequence in a peptide or protein, or (b) a peptide or polypeptide having an amino acid sequence that is substantially identical to a sequence of amino acids in a reference peptide or protein.

The term "co-stimulatory ligand" refers to a molecule on an antigen-presenting cell (e.g., an APC, dendritic cell, B cell, and the like) that specifically binds a cognate co-stimulatory molecule on a T cell, thereby providing a signal which, in addition to the primary signal provided by, for instance, binding of a TCR/CD3 complex with an MHC molecule loaded with peptide, mediates a T cell response, including at least one of proliferation, activation, differentiation, and other cellular responses. A co-stimulatory ligand can include B7-1 (CD80), B7-2 (CD86), PD-L1, PD-L2, 4-1BBL, OX40L, inducible co-stimulatory ligand (ICOS-L), intercellular adhesion molecule (ICAM), CD30L, CD40, CD70, CD83, HLA-G, MICA, MICB, HVEM, lymphotoxin beta receptor, 3/TR6, ILT3, ILT4, HVEM, a ligand for CD7, an agonist or antibody that binds the Toll ligand receptor, and a ligand that specifically binds with B7-H3. A co-stimulatory ligand also includes, inter alia, an agonist or an antibody that specifically binds with a co-stimulatory molecule present on a T cell, such as CD27, CD28, 4-1BB, OX40, CD30, CD40, PD-1, ICOS, lymphocyte function-associated antigen-1 (LFA-1), CD2, CD7, LIGHT, NKG2C, B7-H3, and a ligand that specifically binds CD83.

The term "co-stimulatory molecule" refers to the cognate binding partner on a T cell that specifically binds with a co-stimulatory ligand, thereby mediating a co-stimulatory response by the T cell, such as proliferation. Co-stimulatory molecules include an MHC class I molecule, BTLA, and a Toll-like receptor.

The term "co-stimulatory signal" refers to a signal, which in combination with a primary signal, such as TCR/CD3 ligation, leads to T cell proliferation and/or upregulation or downregulation of key molecules.

The terms "disease" and "condition" may be used interchangeably or may be different in that the particular malady or condition may not have a known causative agent (so that etiology has not yet been worked out), and it is therefore not yet recognized as a disease but only as an undesirable condition or syndrome, wherein a more or less specific set of symptoms have been identified by clinicians. The term "disease" is a state of health of a subject wherein the subject cannot maintain homeostasis, and wherein if the disease is not ameliorated, then the subject's health continues to deteriorate. In contrast, a "disorder" in a subject is a state of health in which the animal is able to maintain homeostasis, but in which the animal's state of health is less favorable than it would be in the absence of the disorder. Left untreated, a disorder does not necessarily cause a further decrease in the animal's state of health.

The term "effective" refers to adequate to accomplish a desired, expected, or intended result. For example, an "effective amount" in the context of treatment may be an amount of a compound sufficient to produce a therapeutic or prophylactic benefit.

The term "encoding" refers to the inherent property of specific sequences of nucleotides in a polynucleotide, such as a gene, a cDNA, or an mRNA, to serve as a template for synthesis of other polymers and macromolecules in biological processes having either a defined sequence of nucleotides (i.e., rRNA, tRNA and mRNA) or a defined sequence of amino acids and the biological properties resulting therefrom. Thus, a gene encodes a protein if transcription and translation of mRNA corresponding to that gene produces the protein in a cell or other biological system. Both the coding strand, the nucleotide sequence of which is identical to the mRNA sequence (except that a "T" is replaced by a "U") and is usually provided in sequence listings, and the non-coding strand, used as the template for transcription of a gene or cDNA, can be referred to as encoding the protein or other product of that gene or cDNA.

The term "exogenous" refers to a molecule that does not naturally occur in a wild-type cell or organism but is typically introduced into the cell by molecular biological techniques. Examples of exogenous polynucleotides include vectors, plasmids, and/or man-made nucleic acid constructs encoding the desired protein. With regard to polynucleotides and proteins, the term "endogenous" or "native" refers to a naturally-occurring polynucleotide or amino acid sequences that may be found in a given wild-type cell or organism. Also, a particular polynucleotide sequence that is isolated from a first organism and transferred to a second organism by molecular biological techniques is typically considered an "exogenous" polynucleotide or amino acid sequence with respect to the second organism. In embodiments, polynucleotide sequences can be "introduced" by molecular biological techniques into a microorganism that already contains such a polynucleotide sequence, for instance, to create one or more additional copies of an otherwise naturally-occurring polynucleotide sequence, and thereby facilitate overexpression of the encoded polypeptide.

The term "expression or overexpression" refers to the transcription and/or translation of a particular nucleotide sequence into a precursor or mature protein, for example, driven by its promoter. "Overexpression" refers to the production of a gene product in transgenic organisms or cells that exceeds levels of production in normal or non-transformed organisms or cells. As defined herein, the term "expression" refers to expression or overexpression.

The term "expression vector" refers to a vector including a recombinant polynucleotide including expression control (regulatory) sequences operably linked to a nucleotide sequence to be expressed. An expression vector includes sufficient cis-acting elements for expression; other elements for expression can be supplied by the host cell or in an in vitro expression system. Expression vectors include all those known in the art, such as cosmids, plasmids (e.g., naked or contained in liposomes), and viruses (e.g., lentiviruses, retroviruses, adenoviruses, and adeno-associated viruses) that incorporate the recombinant polynucleotide.

Viruses can be used to deliver nucleic acids into a cell in vitro and in vivo (in a subject). Examples of viruses useful for delivery of nucleic acids into cells include retrovirus, adenovirus, herpes simplex virus, vaccinia virus, and adeno-associated virus.

There also exist non-viral methods for delivering nucleic acids into a cell, for example, electroporation, gene gun, sonoporation, magnetofection, and the use of oligonucleotides, lipoplexes, dendrimers, and inorganic nanoparticles.

The term "homologous" refers to sequence similarity or sequence identity between two polypeptides or between two polynucleotides when a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared to ×100. For example, if 6 of 10 of the positions in two sequences are matched or homologous, then the two sequences are 60% homologous. By way of example, the DNA sequences ATTGCC and TATGGC share 50% homology. A comparison is made when two sequences are aligned to give maximum homology.

The term "immunoglobulin" or "Ig" refers to a class of proteins, which function as antibodies. The five members included in this class of proteins are IgA, IgG, IgM, IgD, and IgE. IgA is the primary antibody that is present in body secretions, such as saliva, tears, breast milk, gastrointestinal secretions, and mucus secretions of the respiratory and genitourinary tracts. IgG is the most common circulating antibody. IgM is the main immunoglobulin produced in the primary immune response in most subjects. It is the most efficient immunoglobulin in agglutination, complement fixation, and other antibody responses and is important in defense against bacteria and viruses. IgD is the immunoglobulin that has no known antibody function but may serve as an antigen receptor. IgE is the immunoglobulin that mediates immediate hypersensitivity by causing the release of mediators from mast cells and basophils upon exposure to the allergen.

The term "isolated" refers to a material that is substantially or essentially free from components that normally accompany it in its native state. The material can be a cell or a macromolecule such as a protein or nucleic acid. For example, an "isolated polynucleotide," as used herein, refers to a polynucleotide, which has been purified from the sequences which flank it in a naturally-occurring state, e.g., a DNA fragment that has been removed from the sequences that are normally adjacent to the fragment. Alternatively, an "isolated peptide" or an "isolated polypeptide" and the like, as used herein, refer to in vitro isolation and/or purification of a peptide or polypeptide molecule from its natural cellular environment and from association with other components of the cell.

The term "substantially purified" refers to a material that is substantially free from components that are normally associated with it in its native state. For example, a substantially purified cell refers to a cell that has been separated from other cell types with which it is normally associated in its naturally occurring or native state. In some instances, a population of substantially purified cells refers to a homogenous population of cells. In other instances, this term refers simply to a cell that has been separated from the cells with which they are naturally associated in their natural state. In embodiments, the cells are cultured in vitro. In embodiments, the cells are not cultured in vitro.

In the context of the present disclosure, the following abbreviations for the commonly occurring nucleic acid bases are used. "A" refers to adenosine, "C" refers to cytosine, "G" refers to guanosine, "T" refers to thymidine, and "U" refers to uridine.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or an RNA may also include introns to the extent that the nucleotide sequence encoding the protein may, in some version, contain an intron(s).

The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. Moreover, the use of lentiviruses enables the integration of the genetic information into the host chromosome, resulting in stably transduced genetic information. HIV, SIV, and FIV are all examples of lentiviruses. Vectors derived from lentiviruses offer the means to achieve significant levels of gene transfer in vivo.

The term "modulating" refers to mediating a detectable increase or decrease in the level of a response in a subject compared with the level of a response in the subject in the absence of a treatment or compound and/or compared with the level of a response in an otherwise identical but untreated subject. The term encompasses perturbing and/or affecting a native signal or response, thereby mediating a beneficial therapeutic response in a subject, preferably a human.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence, or a ribosome binding site is operably linked to a coding sequence if it is positioned so as to facilitate translation.

The term "under transcriptional control" refers to a promoter being operably linked to and in the correct location and orientation in relation to a polynucleotide to control (regulate) the initiation of transcription by RNA polymerase and expression of the polynucleotide.

The term "overexpressed" tumor antigen or "overexpression" of the tumor antigen is intended to indicate an abnormal level of expression of the tumor antigen in a cell from a disease area such as a solid tumor within a specific tissue or organ of the patient relative to the level of expression in a normal cell from that tissue or organ. Patients having a solid tumor or a hematological malignancy characterized by overexpression of the tumor antigen can be determined by standard assays known in the art.

Solid tumors are abnormal masses of tissue that usually do not contain cysts or liquid areas. Solid tumors can be benign or malignant. Different types of solid tumors are named for the type of cells that form them (such as sarcomas, carcinomas, and lymphomas). Examples of solid tumors, such as sarcomas and carcinomas, include fibrosarcoma, myxosarcoma, liposarcoma, chondrosarcoma, osteosarcoma, synovioma, mesothelioma, Ewing's tumor, leiomyosarcoma, rhabdomyosarcoma, colon carcinoma, lymphoid malignancy, pancreatic cancer, breast cancer, lung cancers, ovarian cancer, prostate cancer, hepatocellular carcinoma, squamous cell carcinoma, basal cell carcinoma, adenocarcinoma, sweat gland carcinoma, medullary thyroid carcinoma, papillary thyroid carcinoma, pheochromocytomas sebaceous gland carcinoma, papillary carcinoma, papillary adenocarcinomas, medullary carcinoma, bronchogenic carcinoma, renal cell carcinoma, hepatoma, bile duct carcinoma, choriocarcinoma, Wilms' tumor, cervical cancer, testicular tumor, seminoma, bladder carcinoma, melanoma, and CNS tumors (such as a glioma (such as brainstem glioma and mixed gliomas), glioblastoma (also known as glioblastoma multiforme), astrocytoma, CNS lymphoma, germinoma, medulloblastoma, Schwannoma craniopharyogioma, ependymoma, pinealoma, hemangioblastoma, acoustic neuroma, oligodendroglioma, menangioma, neuroblastoma, retinoblastoma, and brain metastases).

A solid tumor antigen is an antigen expressed on a solid tumor. In embodiments, solid tumor antigens are also expressed at low levels on healthy tissue. Examples of solid tumor antigens and their related disease tumors are provided in Table 1.

TABLE 1

| Solid Tumor antigen | Disease tumor |
|---|---|
| PRLR | Breast Cancer |
| CLCA1 | colorectal Cancer |
| MUC12 | colorectal Cancer |
| GUCY2C | colorectal Cancer |
| GPR35 | colorectal Cancer |
| CR1L | Gastric Cancer |
| MUC 17 | Gastric Cancer |
| TMPRSS11B | esophageal Cancer |
| MUC21 | esophageal Cancer |
| TMPRSS11E | esophageal Cancer |
| CD207 | bladder Cancer |
| SLC30A8 | pancreatic Cancer |
| CFC1 | pancreatic Cancer |
| SLC12A3 | Cervical Cancer |
| SSTR1 | Cervical tumor |
| GPR27 | Ovary tumor |
| FZD10 | Ovary tumor |
| TSHR | Thyroid Tumor |
| SIGLEC15 | Urothelial cancer |
| SLC6A3 | Renal cancer |
| KISS1R | Renal cancer |
| QRFPR | Renal cancer: |
| GPR119 | Pancreatic cancer |
| CLDN6 | Endometrial cancer/Urothelial cancer |
| UPK2 | Urothelial cancer (including bladder cancer) |
| ADAM12 | Breast cancer, pancreatic cancer, and the like |
| SLC45A3 | Prostate cancer |
| ACPP | Prostate cancer |
| MUC21 | Esophageal cancer |
| MUC16 | Ovarian cancer |
| MS4A12 | Colorectal cancer |
| ALPP | Endometrial cancer |
| CEA | Colorectal carcinoma |
| EphA2 | Glioma |
| FAP | Mesothelioma |
| GPC3 | Lung squamous cell carcinoma |
| IL13-Rα2 | Glioma |
| Mesothelin | Metastatic cancer |
| PSMA | Prostate cancer |
| ROR1 | Breast lung carcinoma |
| VEGFR-II | Metastatic cancer |
| GD2 | Neuroblastoma |
| FR-α | Ovarian carcinoma |
| ErbB2 | Carcinomas |
| EpCAM | Carcinomas |
| EGFRvIII | Glioma-Glioblastoma |
| EGFR | Glioma-NSCL cancer |
| tMUC1 | Cholangiocarcinoma, Pancreatic cancer, Breast |
| PSCA | pancreas, stomach, or prostate cancer |
| FCER2, GPR18, FCRLA, CXCR5, FCRL3, FCRL2, HTR3A, and CLEC17A | breast cancer |
| TRPMI, SLC45A2, and SLC24A5 | lymphoma |
| DPEP3 | melanoma |
| KCNK16 | ovarian, testis |
| LIM2 or KCNV2 | pancreatic |
| SLC26A4 | thyroid cancer |
| CD171 | Neuroblastoma |
| Glypican-3 | Sarcoma |
| IL-13 | Glioma |
| CD79a/b | Lymphoma |
| MAGE A4 | Lung cancer |

The term "parenteral administration" of a composition includes, e.g., subcutaneous (s.c.), intravenous (i.v.), intramuscular (i.m.), intrasternal injection, or infusion techniques.

The terms "patient," "subject," and "individual," and the like are used interchangeably herein and refer to any human or animal, amenable to the methods described herein. In certain non-limiting embodiments, the patient, subject, or individual is a human or animal. In embodiments, the term "subject" is intended to include living organisms in which an immune response can be elicited (e.g., mammals). Examples of subjects include humans, and animals, such as dogs, cats, mice, rats, and transgenic species thereof.

A subject in need of treatment or in need thereof includes a subject having a disease, condition, or disorder that needs to be treated. A subject in need thereof also includes a subject that needs treatment for the prevention of a disease, condition, or disorder.

The term "polynucleotide" or "nucleic acid" refers to mRNA, RNA, CRNA, IRNA, cDNA, or DNA. The term typically refers to a polymeric form of nucleotides of at least 10 bases in length, either ribonucleotides or deoxynucleotides, or a modified form of either type of nucleotide. The term includes all forms of nucleic acids, including single and double-stranded forms of nucleic acids.

The terms "polynucleotide variant" and "variant," and the like refer to polynucleotides displaying substantial sequence identity with a reference polynucleotide sequence or polynucleotides that hybridize with a reference sequence under stringent conditions that are defined hereinafter. These terms also encompass polynucleotides that are distinguished from a reference polynucleotide by the addition, deletion, or substitution of at least one nucleotide. Accordingly, the terms "polynucleotide variant" and "variant" include polynucleotides in which one or more nucleotides have been added or deleted, or replaced with different nucleotides. In this regard, it is well understood in the art that certain alterations inclusive of mutations, additions, deletions, and substitutions can be made to a reference polynucleotide whereby the altered polynucleotide retains the biological function or activity of the reference polynucleotide or has increased activity in relation to the reference polynucleotide (i.e., optimized). Polynucleotide variants include, for example, polynucleotides having at least 50% (and at least 51% to at least 99% and all integer percentages in between, e.g., 90%, 95%, or 98%) sequence identity with a reference polynucleotide sequence described herein. The terms "polynucleotide variant" and "variant" also include naturally-occurring allelic variants and orthologs.

The terms "polypeptide," "polypeptide fragment," "peptide," and "protein" are used interchangeably herein to refer to a polymer of amino acid residues and to variants and synthetic analogues of the same. Thus, these terms apply to amino acid polymers in which one or more amino acid residues are synthetic non-naturally occurring amino acids, such as a chemical analogue of a corresponding naturally occurring amino acid, as well as to naturally-occurring amino acid polymers. In certain aspects, polypeptides may include enzymatic polypeptides, or "enzymes," which typically catalyze (i.e., increase the rate of) various chemical reactions.

The term "polypeptide variant" refers to polypeptides that are distinguished from a reference polypeptide sequence by the addition, deletion, or substitution of at least one amino acid residue. In embodiments, a polypeptide variant is distinguished from a reference polypeptide by one or more substitutions, which may be conservative or non-conservative. In embodiments, the polypeptide variant comprises conservative substitutions, and, in this regard, it is well understood in the art that some amino acids may be changed to others with broadly similar properties without changing the nature of the activity of the polypeptide. Polypeptide variants also encompass polypeptides in which one or more amino acids have been added or deleted, or replaced with different amino acid residues.

The term "promoter" refers to a DNA sequence recognized by the synthetic machinery of the cell or introduced synthetic machinery, required to initiate the specific transcription of a polynucleotide sequence. The term "expression control (regulatory) sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

The term "bind," "binds," or "interacts with" refers to a molecule recognizing and adhering to a second molecule in a sample or organism but does not substantially recognize or adhere to other structurally unrelated molecules in the sample. The term "specifically binds," as used herein with respect to an antibody, refers to an antibody that recognizes a specific antigen but does not substantially recognize or bind other molecules in a sample. For example, an antibody that specifically binds an antigen from one species may also bind that antigen from one or more species. But, such cross-species reactivity does not itself alter the classification of an antibody as specific. In another example, an antibody that specifically binds an antigen may also bind different allelic forms of the antigen. However, such cross reactivity does not itself alter the classification of an antibody as specific. In some instances, the terms "specific binding" or "specifically binding" can be used in reference to the interaction of an antibody, a protein, or a peptide with a second chemical species, to mean that the interaction is dependent upon the presence of a particular structure (e.g., an antigenic determinant or epitope) on the chemical species; for example, an antibody recognizes and binds a specific protein structure rather than to any protein. If an antibody is specific for epitope "A," the presence of a molecule containing epitope A (or free, unlabeled A) in a reaction containing labeled "A" and the antibody will reduce the amount of labeled A bound to the antibody.

By "statistically significant," it is meant that the result was unlikely to have occurred by chance. Statistical significance can be determined by any method known in the art. Commonly used measures of significance include the p-value, which is the frequency or probability with which the observed event would occur if the null hypothesis were true. If the obtained p-value is smaller than the significance level, then the null hypothesis is rejected. In simple cases, the significance level is defined at a p-value of 0.05 or less. A "decreased" or "reduced" or "lesser" amount is typically a "statistically significant" or a physiologically significant amount and may include a decrease that is about 1.1, 1.2, 1.3, 1.4, 1.5, 1.6 1.7, 1.8, 1.9, 2, 2.5, 3, 3.5, 4, 4.5, 5, 6, 7, 8, 9, 10, 15, 20, 30, 40, or 50 or more times (e.g., 100, 500, 1000 times) (including all integers and decimal points in between and above 1, e.g., 1.5, 1.6, 1.7. 1.8, etc.) an amount or level described herein.

The term "stimulation" refers to a primary response induced by binding of a stimulatory molecule (e.g., a TCR/CD3 complex) with its cognate ligand, thereby mediating a signal transduction event, such as signal transduction via the TCR/CD3 complex. Stimulation can mediate altered expression of certain molecules, such as downregulation of TGF-β and/or reorganization of cytoskeletal structures.

The term "stimulatory molecule" refers to a molecule on a T cell that specifically binds a cognate stimulatory ligand present on an antigen-presenting cell. For example, a functional signaling domain derived from a stimulatory molecule is the zeta chain associated with the T cell receptor complex. The stimulatory molecule includes a domain responsible for signal transduction.

The term "stimulatory ligand" refers to a ligand that when present on an antigen-presenting cell (e.g., an APC, a dendritic cell, a B-cell, and the like.) can specifically bind with a cognate binding partner (referred to herein as a "stimulatory molecule") on a cell, for example, a T cell, thereby mediating a primary response by the T cell, including activation, initiation of an immune response, proliferation, and similar processes. Stimulatory ligands are well-known in the art and encompass, inter alia, an MHC Class I molecule loaded with a peptide, an anti-CD3 antibody, a superagonist anti-CD28 antibody, and a superagonist anti-CD2 antibody.

The term "therapeutic" refers to treatment and/or prophylaxis. A therapeutic effect is obtained by suppression, remission, or eradication of a disease state or alleviating the symptoms of a disease state.

The term "therapeutically effective amount" refers to the amount of the subject compound that will elicit the biological or medical response of a tissue, system, or subject that is being sought by the researcher, veterinarian, medical doctor, or another clinician. The term "therapeutically effective amount" includes that amount of a compound that, when administered, is sufficient to prevent the development of, or alleviate to some extent, one or more of the signs or symptoms of the disorder or disease being treated. The therapeutically effective amount will vary depending on the compound, the disease and its severity and the age, weight, etc., of the subject to be treated.

The term "treat a disease" refers to the reduction of the frequency or severity of at least one sign or symptom of a disease or disorder experienced by a subject.

The term "transfected" or "transformed" or "transduced" refers to a process by which an exogenous nucleic acid is transferred or introduced into the host cell. A "transfected" or "transformed" or "transduced" cell is one that has been transfected, transformed, or transduced with an exogenous nucleic acid. The cell includes the primary subject cell and its progeny.

The term "vector" refers to a polynucleotide that comprises an isolated nucleic acid and which can be used to deliver the isolated nucleic acid to the interior of a cell. Numerous vectors are known in the art including linear polynucleotides, polynucleotides associated with ionic or amphiphilic compounds, plasmids, and viruses. Thus, the term "vector" includes an autonomously replicating plasmid or a virus. The term also includes non-plasmid and non-viral compounds that facilitate the transfer of nucleic acid into cells, such as, for example, polylysine compounds, liposomes, and the like. Examples of viral vectors include adenoviral vectors, adeno-associated virus vectors, retroviral vectors, and others. For example, lentiviruses are complex retroviruses, which, in addition to the common retroviral genes gag, pol, and env, contain other genes with regulatory or structural function. Lentiviral vectors are well known in the art. Some examples of lentivirus include the Human Immunodeficiency Viruses: HIV-1, HIV-2, and the Simian Immunodeficiency Virus: SIV. Lentiviral vectors have been generated by multiply attenuating the HIV virulence genes, for example, the genes env, vif, vpr, vpu, and nef are deleted, making the vector biologically safe.

Ranges: throughout this disclosure, various aspects of the disclosure can be presented in a range format. It should be understood that the description in range format is merely for convenience and brevity and should not be construed as an inflexible limitation on the scope of the disclosure. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6, etc., as well as individual numbers within that range, for example, 1, 2, 2.7, 3, 4, 5, 5.3, and 6. This applies regardless of the breadth of the range.

While CAR T cell therapy achieves strong antitumor activities against blood tumor, CAR T therapy alone, at least for certain solid tumor types, may not be enough to overcome tumor micro-environment, inhibit tumor growth, and eventually treat cancer patients. Therapeutic agents such as cytokine may enhance the cell therapy when immune cells are modified to express a therapeutic agent in the body of patients. However, the expression of therapeutic agents should be regulated to avoid potential toxicity caused by the therapeutic agents.

The present disclosure provides compositions and methods to treat cancer patients using modified cell expressing one or more therapeutic agents with engineered safety. In many cases, multiple safety controls may need. For example, nuclear factor of activated T cells (NFAT) driven cytokines such as IL12 has been used to safely drive IL12 to be expressed and secreted by T cells. In a scenario such as CoupledCAR®, solid tumor CAR T cells may be activated without contacting their antigens. In another scenario, there may be normal tissue expressing the antigen that CAR T cells bind. In these instances, the activated T cells may express and release IL12 until they are exhausted, increasing the risk of toxicity caused by IL12. Having a second safety switch may avoid the risk. In embodiments, additional engineered safety may enable functionalities of T cells to be enhanced (e.g., expressing IL12) when the T cells enter the tumor micro-environment.

A "chimeric antigen receptor" (CAR) molecule is a recombinant polypeptide including at least an extracellular domain, a transmembrane domain, and a cytoplasmic domain or intracellular domain. In embodiments, the domains of the CAR are on the same polypeptide chain, for example, a chimeric fusion protein. In embodiments, the domains are on different polypeptide chains, for example, the domains are not contiguous.

The extracellular domain of a CAR molecule includes an antigen binding domain. The antigen binding domain is for expanding and/or maintaining the modified cells, such as a CAR T cell, or for killing a tumor cell, such as a solid tumor. In embodiments, the antigen binding domain for expanding and/or maintaining modified cells binds an antigen, for example, a cell surface molecule or marker, on the surface of a WBC. In embodiments, the WBC is at least one of GMP (granulocyte macrophage precursor), MDP (monocyte-macrophage/dendritic cell precursors), cMoP (common monocyte precursor), basophil, eosinophil, neutrophil, SatM (Segerate-nucleus-containing atypical monocyte), macrophage, monocyte, CDP (common dendritic cell precursor), cDC (conventional DC), pDC (plasmacytoid DC), CLP (common lymphocyte precursor), B cell, ILC (Innate Lymphocyte), NK cell, megakaryocyte, myeloblast, pro-myelocyte, myelocyte, meta-myelocyte, band cells, lymphoblast, prolymphocyte, monoblast, megakaryoblast, promegakaryocyte, megakaryocyte, platelets, or MSDC (Myeloid-derived suppressor cell). In embodiments, the WBC is a granulocyte, monocyte, and or lymphocyte. In embodiments, the WBC is a lymphocyte, for example, a B cell. In embodiments, the WBC is a B cell. In embodiments, the cell surface molecule of a B cell includes CD19, CD22, CD20, BCMA, CD5, CD7, CD2, CD16, CD56, CD30, CD14, CD68, CD11b, CD18, CD169, CD1c, CD33, CD38, CD138, or CD13. In embodiments, the cell surface molecule of the B cell is CD19, CD20, CD22, or BCMA. In embodiments, the cell surface molecule of the B cell is CD19. In embodiments, the cell surface molecule is CD79A.

The cells described herein, including modified cells such as CAR cells and modified T cells, can be derived from stem cells. Stem cells may be adult stem cells, embryonic stem cells, more particularly non-human stem cells, cord blood stem cells, progenitor cells, bone marrow stem cells, induced pluripotent stem cells, totipotent stem cells, or hematopoietic stem cells. A modified cell may also be a dendritic cell, an NK cell, a B cell, or a T cell selected from the group consisting of inflammatory T-lymphocytes, cytotoxic T-lymphocytes, regulatory T lymphocytes, or helper T-lymphocytes. In embodiments, Modified cells may be derived from the group consisting of CD4+ T lymphocytes and CD8+ T lymphocytes. Prior to the expansion and genetic modification of the cells of the invention, a source of cells may be obtained from a subject through a variety of non-limiting methods. T cells may be obtained from a number of non-limiting sources, including peripheral blood mononuclear cells, bone marrow, lymph node tissue, cord blood, thymus tissue, tissue from a site of infection, ascites, pleural effusion, spleen tissue, and tumors. In embodiments of the present invention, any number of T cell lines available and known to those skilled in the art may be used. In embodiments, modified cells may be derived from a healthy donor, from a patient diagnosed with cancer, or from a patient diagnosed with an infection. In embodiments, a modified cell is part of a mixed population of cells that present different phenotypic characteristics.

A population of cells refers to a group of two or more cells. The cells of the population could be the same, such that the population is a homogenous population of cells. The cells of the population could be different, such that the population is a mixed population or a heterogeneous population of cells. For example, a mixed population of cells could include modified cells comprising a first CAR and cells comprising a second CAR, wherein the first CAR and the second CAR bind different antigens.

The term "stem cell" refers to any of certain types of cell which have the capacity for self-renewal and the ability to differentiate into other kind(s) of a cell. For example, a stem cell gives rise either to two daughter stem cells (as occurs in vitro with embryonic stem cells in culture) or to one stem cell and a cell that undergoes differentiation (as occurs, e.g., in hematopoietic stem cells, which give rise to blood cells). Different categories of stem cells may be distinguished on the basis of their origin and/or on the extent of their capacity for differentiation into other types of cells. For example, stem cells may include embryonic stem (ES) cells (i.e., pluripotent stem cells), somatic stem cells, induced pluripotent stem cells, and any other types of stem cells.

The pluripotent embryonic stem cells are found in the inner cell mass of a blastocyst and have an innate capacity for differentiation. For example, pluripotent embryonic stem cells have the potential to form any type of cell in the body. When grown in vitro for long periods of time, ES cells maintain pluripotency as progeny cells retain the potential for multilineage differentiation.

Somatic stem cells can include fetal stem cells (from the fetus) and adult stem cells (found in various tissues, such as bone marrow). These cells have been regarded as having a capacity for differentiation that is lower than that of the pluripotent ES cells—with the capacity of fetal stem cells being greater than that of adult stem cells. Somatic stem cells apparently differentiate into only a limited number of types of cells and have been described as multipotent. The "tissue-specific" stem cells normally give rise to only one type of cell. For example, embryonic stem cells may be differentiated into blood stem cells (e.g., Hematopoietic stem cells (HSCs)), which may be further differentiated into various blood cells (e.g., red blood cells, platelets, white blood cells, etc.).

Induced pluripotent stem cells (i.e., iPS cells or iPSCs) may include a type of pluripotent stem cell artificially derived from a non-pluripotent cell (e.g., an adult somatic cell) by inducing an expression of specific genes. Induced pluripotent stem cells are similar to natural pluripotent stem cells, such as embryonic stem (ES) cells, in many aspects, such as the expression of certain stem cell genes and proteins, chromatin methylation patterns, doubling time, embryoid body formation, teratoma formation, viable chimera formation, and potency and differentiability. Induced pluripotent cells can be obtained from adult stomach, liver, skin, and blood cells.

In embodiments, the antigen binding domain for killing a tumor binds an antigen on the surface of a tumor, for example, a tumor antigen or tumor marker. Tumor antigens are proteins that are produced by tumor cells that elicit an immune response, particularly T cell-mediated immune responses. Tumor antigens are well known in the art and include, for example, tumor-associated MUC1 (tMUC1), a glioma-associated antigen, carcinoembryonic antigen (CEA), β-human chorionic gonadotropin, alphafetoprotein (AFP), lectin-reactive AFP, thyroglobulin, RAGE-1, MN-CA IX, human telomerase reverse transcriptase, RU1, RU2 (AS), intestinal carboxyl esterase, mut hsp70-2, M-CSF, prostase, prostate-specific antigen (PSA), PAP, NY-ESO-1, LAGE-1a, p53, prostein, PSMA, Her2/neu, surviving, telomerase, prostate-carcinoma tumor antigen-1 (PCTA-1), MAGE, ELF2M, neutrophil elastase, ephrinB2, CD22, insulin growth factor (IGF)-I, IGF-II, IGF-I receptor, CD19, and mesothelin. For example, when the tumor antigen is CD19, the CAR thereof can be referred to as CD19 CAR or 19CAR, which is a CAR molecule that includes an antigen binding domain that binds CD19.

In embodiments, the extracellular antigen binding domain of a CAR includes at least one scFv or at least a single domain antibody. As an example, there can be two scFvs on a CAR. The scFv includes a light chain variable (VL) region and a heavy chain variable (VH) region of a target antigen-specific monoclonal antibody joined by a flexible linker. Single chain variable region fragments can be made by linking light and/or heavy chain variable regions by using a short linking peptide (Bird et al., Science 242:423-426, 1988). An example of a linking peptide is the GS linker having the amino acid sequence (GGGGS)$_3$ (SEQ ID NO: 278), which bridges approximately 3.5 nm between the carboxy terminus of one variable region and the amino terminus of the other variable region. Linkers of other sequences have been designed and used (Bird et al., 1988, supra). In general, linkers can be short, flexible polypeptides and preferably comprised of about 20 or fewer amino acid residues. The single-chain variants can be produced either recombinantly or synthetically. For the synthetic production of scFv, an automated synthesizer can be used. For recombinant production of scFv, a suitable plasmid containing a polynucleotide that encodes the scFv can be introduced into a suitable host cell, either eukaryotic, such as yeast, plant, insect, or mammalian cells, or prokaryotic, such as E. coli. Polynucleotides encoding the scFv of interest can be made by routine manipulations such as ligation of polynucle-otides. The resultant scFv can be isolated using standard protein purification techniques known in the art.

The cytoplasmic domain of the CAR molecules described herein includes one or more co-stimulatory domains and one or more signaling domains. The co-stimulatory and signaling domains function to transmit the signal and activate molecules, such as T cells, in response to antigen binding. The one or more co-stimulatory domains are derived from stimulatory molecules and/or co-stimulatory molecules, and the signaling domain is derived from a primary signaling domain, such as the CD3 zeta domain. In embodiments, the signaling domain further includes one or more functional signaling domains derived from a co-stimulatory molecule. In embodiments, the co-stimulatory molecules are cell surface molecules (other than antigens receptors or their ligands) that are required for activating a cellular response to an antigen.

In embodiments, the co-stimulatory domain includes the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that specifically binds with CD83, or any combination thereof. In embodiments, the signaling domain includes a CD3 zeta domain derived from a T cell receptor.

The CAR molecules described herein also include a transmembrane domain. The incorporation of a transmembrane domain in the CAR molecules stabilizes the molecule. In embodiments, the transmembrane domain of the CAR molecules is the transmembrane domain of a CD28 or 4-1BB molecule.

Between the extracellular domain and the transmembrane domain of the CAR, there may be incorporated a spacer domain. As used herein, the term "spacer domain" generally means any oligo- or polypeptide that functions to link the transmembrane domain to the extracellular domain and/or the cytoplasmic domain on the polypeptide chain. A spacer domain may include up to 300 amino acids, preferably 10 to 100 amino acids, and most preferably 25 to 50 amino acids.

The present disclosure describes a polynucleotide comprising an NFAT promoter, a nucleotide sequence encoding therapeutic agent, and a nucleotide sequence encoding a VHL-interaction domain of hypoxia-inducible factor 1-alpha (HIF1α).

The present disclosure describes a polynucleotide comprising a promoter corresponding to Hif1a, NFAT, FOXP3, or NFkB, a nucleotide sequence encoding a therapeutic agent, and a nucleotide sequence encoding an oxygen-sensitive polypeptide domain.

In embodiments, the therapeutic agent comprises at least one of IL-12, IL-6, IL-7, IL-15, IL-2, IL-23, GCSF, and GM-CSF.

"NFAT promoter" refers to one or more NFAT responsive elements linked to a minimal promoter of any gene expressed by T-cells. In embodiments, the minimal promoter of a gene expressed by T-cells is a minimal human IL-2 promoter. The NFAT responsive elements may comprise, e.g., NFAT1, NFAT2, NFAT3, and/or NFAT4 responsive elements. The NFAT promoter (or a functional portion or functional variant thereof) may comprise any number of binding motifs, e.g., at least two, at least three, at least four, at least five, or at least six, at least seven, at least eight, at least nine, at least ten, at least eleven, or up to twelve binding motifs. In embodiments, the NFAT promoter comprises six NFAT binding motifs. In an embodiment, the NFAT promoter nucleotide sequence comprises or consists of SEQ ID NO: 93 or a functional portion or functional variant thereof.

The NFAT promoter (or a functional portion or functional variant thereof) is operatively associated with the nucleotide sequence encoding a therapeutic agent (or a functional portion or functional variant thereof). "Operatively associated with" means that the nucleotide sequence encoding the therapeutic agent (or a functional portion or functional variant thereof) is transcribed into therapeutic agent mRNA when the NFAT protein binds to the NFAT promoter sequence (or a functional portion or functional variant thereof). Without being bound to a particular theory, it is believed that NFAT is regulated by a calcium signaling pathway. In particular, it is believed that TCR stimulation (by, e.g., an antigen) and/or stimulation of the calcium signaling pathway of the cell (by, e.g., PMA/Ionomycin) increases intracellular calcium concentration and activates calcium channels. It is believed that the NFAT protein is then dephosporylated by calmoduin and translocates to the nucleus, where it binds with the NFAT promoter sequence (or a functional portion or functional variant thereof) and activates downstream gene expression. By providing an NFAT promoter (or a functional portion or functional variant thereof) that is operatively associated with the nucleotide sequence encoding a therapeutic agent, for example, a cytokine (or a functional portion or functional variant thereof), the nucleic acids of the invention advantageously make it possible to express the therapeutic agent (or a functional portion or functional variant thereof) only when the host cell including the nucleic acid is stimulated by, e.g., PMA/Ionomycin and/or an antigen. More information can be found at U.S. Pat. No. 8,556,882, which is incorporated by the reference.

In embodiments, the oxygen-sensitive polypeptide domain is HIF1 alpha, HIF3 alpha, or a polypeptide comprising an amino acid sequence having a sequence identity of over 80%, 90%, or 95% with respectively Hif VHL-interaction domain, Hif amino acid 344-417, or Hif amino acid 380-603. In embodiments, the oxygen-sensitive polypeptide domain comprises HIF VHL binding domain.

In embodiments, the therapeutic agent comprises or is a cytokine. In embodiments, the therapeutic agent comprises or is IL-1P, IL-2, IL-4, IL-5, IL-6, IL-8, IL-10, IL-12, IL-13, IL-15, IL-17, IL-1Ra, IL-2R, IFN-γ, IFN-γ, MIP-In, MIP-IP, MCP-1, TNFα, GM-CSF, GCSF, CXCL9, CXCL10, CXCR factors, VEGF, RANTES, EOTAXIN, EGF, HGF, FGF-P, CD40, CD40L, ferritin, and any combination thereof. In embodiments, the cytokines include proinflammatory cytokines such as IFN-γ, IL-15, IL-4, IL-10, TNFα, IL-8, IL-5, IL-6, GM-CSF, and/or MIP-Iα. In embodiments, the therapeutic agent comprises or is IL-12, IL-6, IL-7, IL-15, IL-23, GCSF, and/or GM-CSF The present disclosure describes a kit comprising an effective amount of vector-free nucleic acids comprising the polynucleotide of any preceding embodiments to render a population of immune cells specific for a tumor antigen expressed on the surface of the cells of a subject.

The present disclosure describes a method or use of polynucleotide, the method comprising providing a viral particle (e.g., AAV, lentivirus or their variants) comprising a vector genome, the vector genome comprising the polynucleotide and a polynucleotide encoding an antigen binding molecule, the polynucleotide operably linked to an expression control element conferring transcription of the polynucleotides; and administering an amount of the viral particle to a subject such that the polynucleotide is expressed in the subject, where the one or more molecules are overexpressed in cancer cells, associated with recruitment of immune cells, and/or associated with autoimmunity. In embodiments, the AAV preparation may include AAV vector particles, empty capsids, and host cell impurities, thereby providing an AAV product substantially free of AAV empty capsids.

The present disclosure describes a modified cell comprising the polynucleotide. In embodiments, the modified cell comprises the antigen binding molecule, the antigen binding molecule is chimeric antigen receptor (CAR), which comprises an antigen-binding domain, a transmembrane domain, and an intracellular signaling domain. In embodiments, the antigen-binding domain binds to a tumor antigen is selected from a group consisting of: TSHR, CD19, CD123, CD22, CD30, CD171, CS-1, CLL-1, CD33, EGFRvIII, GD2, GD3, BCMA, Tn Ag, PSMA, ROR1, FLT3, FAP, TAG72, CD38, CD44v6, CEA, EPCAM, B7H3, KIT, IL-13Ra2, Mesothelin, IL-11Ra, PSCA, PRSS21, VEGFR2, LewisY, CD24, PDGFR-beta, SSEA-4, CD20, Folate receptor alpha, ERBB2 (Her2/neu), MUC1, EGFR, NCAM, Prostase, PAP, ELF2M, Ephrin B2, IGF-I receptor, CAIX, LMP2, gp100, bcr-abl, tyrosinase, EphA2, Fucosyl GM1, sLe, GM3, TGS5, HMWMAA, o-acetyl-GD2, Folate receptor beta, TEM1/CD248, TEM7R, CLDN6, GPRC5D, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, NY-ESO-1, LAGE-1a, MAGE-A1, legumain, HPV E6, E7, MAGE A1, ETV6-AML, sperm protein 17, XAGE1, Tie 2, MAD-CT-1, MAD-CT-2, Fos-related antigen 1, p53, p53 mutant, prostein, survivin and telomerase, PCTA-1/Galectin 8, MelanA/MART1, Ras mutant, hTERT, sarcoma translocation breakpoints, ML-IAP, ERG (TMPRSS2 ETS fusion gene), NA17, PAX3, Androgen receptor, Cyclin B1, MYCN, RhoC, TRP-2, CYP1B1, BORIS, SART3, PAX5, OY-TES1, LCK, AKAP-4, SSX2, RAGE-1, human telomerase reverse transcriptase, RU1, RU2, intestinal carboxyl esterase, mut hsp70-2, CD79a, CD79b, CD72, LAIR1, FCAR, LILRA2, CD300LF, CLEC12A, BST2, EMR2, LY75, GPC3, FCRL5, and IGLL1. In embodiments, the intracellular signaling domain comprises a co-stimulatory signaling domain, or a primary signaling domain and a co-stimulatory signaling domain, wherein the co-stimulatory signaling domain comprises a functional signaling domain of a protein selected from the group consisting of CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, a ligand that specifically binds with CD83, CDS, ICAM-1, GITR, BAFFR, HVEM (LIGHTR), SLAMF7, NKp80 (KLRF1), CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, NKp44, NKp30, NKp46, and NKG2D In embodiments, the modified cell comprises the antigen binding molecule, the antigen binding molecule is a modified TCR. In embodiments, the TCR is derived from spontaneously occurring tumor-specific T cells in patients. In embodiments, the TCR binds to a tumor antigen. In embodiments, the tumor antigen comprises CEA, gp100, MART-1, p53, MAGE-A3, or NY-ESO-1. In embodiments, the TCR comprises TCRγ and TCRδ Chains or TCRα and TCRβ chains, or a combination thereof.

In embodiments, the cell is an immune cell (e.g., a population of immune effector cells). In embodiments, the immune cell is a T cell or an NK cell. In embodiments, the immune effector cell is a T cell. In embodiments, the T cell is a CD4+ T cell, a CD8+ T cell, or a combination thereof. In embodiments, the cell is a human cell.

In embodiments, the modified cell comprises a nucleic acid sequence encoding a binding molecule and a dominant negative form of an inhibitory immune checkpoint molecule or a receptor thereof. In embodiments, the inhibitory immune checkpoint molecule is selected from the group consisting of programmed death 1 (PD-1), cytotoxic T lymphocyte antigen-4 (CTLA-4), B- and T-lymphocyte attenuator (BTLA), T cell immunoglobulin mucin-3 (TIM-3), lymphocyte-activation protein 3 (LAG-3), T cell immunoreceptor with Ig and ITIM domains (TIGIT), leukocyte-associated immunoglobulin-like receptor 1 (LAIR1), natural killer cell receptor 2B4 (2B4), and CD 160. In embodiments, the inhibitory immune checkpoint molecule is modified PD-1. In embodiments, the modified PD-1 lacks a functional PD-1 intracellular domain for PD-1 signal transduction, interferes with a pathway between PD-1 of a human T cell of the human cells and PD-L1 of a certain cell, comprises or is a PD-1 extracellular domain or a PD-1 transmembrane domain, or a combination thereof, or a modified PD-1 intracellular domain comprising a substitution or deletion as compared to a wild-type PD-1 intracellular domain, or comprises or is a soluble receptor comprising a PD-1 extracellular domain that binds to PD-L1 of a certain cell.

In embodiments, the modified cell is engineered to express and secrete a therapeutic agent such as a cytokine. In embodiments, the therapeutic agent is or comprises IL-6 or IFN-γ, or a combination thereof. In embodiments, the therapeutic agent is or comprises IL-15 or IL-12, or a combination thereof. In embodiments, the small protein or the therapeutic agent is or comprises a recombinant or native cytokine. In embodiments, the small protein is or comprises IL-12, IL-6, or IFN-γ. In embodiments, the modified cell is derived from a healthy donor or the subject having cancer.

In embodiments, the modified ell has a reduced expression of the endogenous T cell receptor alpha constant (TRAC) gene.

In embodiments, the modified cell comprises a first CAR binding a white blood antigen and a second CAR binding a solid tumor antigen. In embodiments, the modified cell comprises a bispecific CAR binding a white blood antigen and a solid tumor antigen.

The present disclosure describes a pharmaceutical composition comprising a population of the modified cells and a population of additional modified cells, wherein the modified cells bind a first antigen, and the additional modified cells bind a second antigen, which is different from the first antigen. In embodiments, the first antigen is a white blood cell antigen, and the second antigen is a solid tumor antigen. In embodiments, the second antigen is a white blood cell antigen, and the first antigen is a solid tumor antigen. In embodiments, the white blood cell antigen is CD19, CD22, CD20, BCMA, CD5, CD7, CD2, CD16, CD56, CD30, CD14, CD68, CD11b, CD18, CD169, CD1c, CD33, CD38, CD138, or CD13.

In embodiments, the first antigen is CD205, CD19, CD20, CD22, or BCMA. In embodiments, the second antigen is a solid tumor antigen. Examples of the solid tumor antigen are tMUC 1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, CLDN18.2, QRFPR, GPR119, CLDN6, UPK2, ADAM12, SLC45A3, ACPP, MUC21, MUC16, MS4A12, ALPP, CEA, EphA2, FAP, GPC3, IL13-Ra2, Mesothelin, PSMA, ROR1, VEGFR-II, GD2, FR-α, ErbB2, EpCAM, EGFRvIII, B7-H3, or EGFR.

In embodiments, the solid tumor antigen comprises tumor associated MUC1, ACPP, TSHR, GUCY2C, UPK2, CLDN18.2, PSMA, DPEP3, CXCR5, B7-H3, MUC16, SIGLEC-15, CLDN6, Muc17, PRLR, and FZD10.

The present disclosure describes a method of eliciting or enhancing T cell response, treating a subject in need thereof, or enhancing cancer treatment thereof, the method comprising administering an effective amount of the pharmaceutical composition herein. In embodiments, the solid tumor antigen is ACPP, and the cancer is prostate.

In embodiments, the binding molecule and/or therapeutic agent is associated with a suicide gene. In embodiments, the polynucleotide comprises a suicide gene. In embodiments, the suicide gene is RQR8. "Suicide gene" is a nucleic acid coding for a product, wherein the product causes cell death by itself or in the presence of other compounds. A representative example of such a therapeutic nucleic acid (suicide gene) is one that codes for thymidine kinase of herpes simplex virus (HSV-TK) or RQR8. Additional examples are thymidine kinase of varicella-zoster virus and the bacterial gene cytosine deaminase, which can convert 5-fluorocytosine to the highly toxic compound 5-fluorouracil. Embodiments include a 136 amino acid marker/suicide gene for T-cells. The translated protein is stably expressed on the cell surface after retroviral transduction. It binds QBEND10 with equal affinity to full length CD34. Further, the construct binds Rituximab, and the dual epitope design engenders highly effective complement-mediated killing. Due to the small size of the construct, it can easily be co-expressed with typical T-cell engineering transgenes such as T-cell receptors or Chimeric Antigen Receptors and others, allowing facile detection, cell selection as well as deletion of cells in the face of unacceptable toxicity with off the shelf clinical-grade reagents/pharmaceuticals. More information on RQR8 and suicide gene can be found at EPO Patent Publication NO: EP2836511, which is incorporated here by reference.

It has been reported that clinical trials using IL-12 to treat cancer resulted in low response and high toxicity and, thus, were stopped (e.g., Motzer et al. in Journal of Interferon and Cytokine Research 21:257-263, 2001). The present disclosure provides a safe and effective therapy to treat cancer such as lymphoma using IL-12. For example, a method for treating a subject having lymphoma, enhancing the treatment thereof, enhancing Anti-Tumor activities in the subject, or enhancing T cell response in the subject, the method comprises: administering an effective amount of modified cells herein to the subject, wherein the modified cells comprise the polynucleotide comprising an NFAT promoter, a nucleotide sequence encoding therapeutic agent, and/or a nucleotide sequence encoding a VHL-interaction domain of HIF1α, wherein the therapeutic agent comprises at least one of IL-12, the modified cells comprise a CAR or TCR binding CD19, CD20, and/or CD22. More information about CAR T cells can be found at U.S. application Ser. No. 16/439,901, which is incorporated herein by its reference.

The present disclosure describes a composition comprising a population of mixed cells. The mixed cells comprise a first population of cells comprising a first CAR binding a first antigen, and a second population of cells comprising a second CAR binding a second antigen, the first antigen comprising CD205, and the second antigen comprising a solid tumor antigen.

The present disclosure describes a method of enhancing expansion of cells in a subject, the method comprising: administering an effective amount of a composition to the subject having a form of cancer expressing a tumor antigen, wherein the composition comprises a first population of cells comprising a first CAR binding a first antigen, and a second population of cells comprising a second CAR binding a second antigen, the first antigen comprising CD205 and the second antigen comprising a solid tumor antigen; and allowing the first and second population of cells to expand, wherein expansion of the second population of cells in the subject is enhanced as compared to a subject administered a composition comprising the second population of cells without the first population of cells.

CD205 is also known as DEC-205, or Lymphocyte antigen 75 (LY75) and is a protein encoded by the LY75 gene. CD205 is a type I C-type lectin receptor normally expressed on various APC and some leukocyte sub-populations, characterized by a cytoplasmic domain-containing protein motif crucial for endocytosis and internalization. CD205 is a surface multilectin receptor with a cytoplasmatic domain-containing protein motifs crucial for endocytosis and internalization upon ligation. CD205 is known to act as a surface receptor for apoptotic and necrotic cells, leading to antigen uptake and processing. CD205 is expressed in hematopoietic cells, mainly by antigen-presenting cells (APC), but also in other tissues, including solid tumors. CD205 presents a rapid internalization rate and a favorable profile in terms of differential expression between neoplastic and healthy tissues and is a good target for CoupledCAR® technology. More information on CD205 and its uses in treating cancer can be found at Gaudio et al., at doi.org/10.3324/haematol.2019.227215.

In embodiments, the first population of cells is T cells, NK cells, or dendritic cells, and wherein the second population of cells is T cells, NK cells, or dendritic cells.

In embodiments, the solid tumor antigen is tMUC 1, PRLR, CLCA1, MUC 12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Ra2, Mesothelin, PSMA, ROR1, VEGFR-II, GD2, FR-α, ErbB2, EpCAM, EGFRvlll, B7-H3, MAGE A4, or EGFR.

In embodiments, the first CAR and the second CAR comprise an antigen binding domain, a transmembrane domain, a co-stimulatory domain, and a CD3 zeta domain. In embodiments, the co-stimulatory domain comprises the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that binds CD83, or a combination thereof. In embodiments, the first CAR comprises an scFv binding CD19, an intracellular domain of 4-1BB or CD28, and a CD3 zeta domain, and the second CAR comprises an scFv binding tMUC1, an intracellular domain of 4-1BB or CD28, and a CD3 zeta domain.

In embodiments, an antigen binding domain of the first CAR comprises an amino acid sequence of SEQ ID NO: 523 or 524 or 522. In embodiments, the second population of cells comprises a lentiviral vector encoding the second CAR and a dominant negative form of PD-1. In embodiments, the first population of cells comprises a lentiviral vector encoding the first CAR and a therapeutic agent. In embodiments, the therapeutic agent comprises a cytokine. In embodiments, the cytokine is IL6 and/or IFN-γ. In embodiments, the cytokine is at least one of IL6, IL12, IL-2, TNF-α, or IFN-γ.

In embodiments, IL2 is IL2v comprising the amino acid sequence of IL2 and the Asp20Thr, Asn88Arg, and Gln126Asp mutations, which can eliminate the binding of IL2 to the CD25 receptor on Treg, reduce immunosuppression, and enhance anti-tumor activity. In embodiments, IL2v comprises the SEQ ID NO: 525.

In embodiments, the method further comprises treating the subject having solid tumor cancer. In embodiments, the solid tumor cancer is cholangiocarcinoma, pancreatic cancer, breast cancer, colorectal cancer, thyroid cancer, or prostate cancer. In embodiments, the solid tumor antigen is tMUC1. In embodiments, the solid tumor antigen is GUCY2C. In embodiments, the solid tumor antigen is TSHR. In embodiments, the solid tumor is CLND18.2. In embodiments, the solid tumor antigen is ACPP. In embodiments, the solid tumor antigen is MAGE A4. In embodiments, the first population of cells is T cells. In embodiments, the first population of cells is T cells or NK cells.

The present disclosure describes a composition comprising a population of a first population of cells comprising a first CAR binding a first antigen, and a second population of cells comprising a second CAR binding a second antigen, the first CAR comprising the amino acid sequence of SEQ ID NO: 523 or 524, the second CAR comprising the amino acid sequence of SEQ ID NO: TSHR, GCC, CLND18.2, MAGE A4, or ACPP, the first antigen comprises CD205, and the second antigen comprising a solid tumor antigen.

More information about CAR T cells can be found at U.S. application Ser. No. 16/439,901, which is incorporated herein by reference in its entirety.

Exemplary Embodiments

The following are exemplary embodiments:

1. A population of modified cells effective for expanding and/or maintaining the modified cells in a patient, wherein the population of modified cells comprises at least two different modified cells: a first modified cell comprising an antigen binding domain for expanding and/or maintaining the modified cells; and a second modified cell comprising an antigen binding domain for killing a target cell, such as a tumor cell. In embodiments, the modified cells are modified T cells. In embodiments, the at least two different modified cells include two different modified T cells, two different modified immune cells, or a combination thereof. In embodiments, the modified immune cells include modified T cells, DC cells, and/or macrophages.

2. The population of modified cells of embodiment 1, wherein the antigen binding domains bind different antigens.

3. The population of modified cells of embodiment 1, wherein the population of modified cells further comprises a third modified cell expressing at least two different antigen binding domains, a first antigen binding domain for expanding and/or maintaining the modified cells and a second antigen binding domain for killing a target cell, and wherein the two different antigen binding domains are expressed on the same cell.

4. The population of modified cells of embodiment 1, wherein the population of modified cells comprises a modified cell expressing an antigen binding domain for killing a target cell and a modified cell expressing at least two antigen binding domains, a first antigen binding domain for expanding and/or maintaining the modified cells and a second antigen binding domain for killing a target cell, and wherein the two different antigen binding domains are expressed on the same modified cell.

5. The population of modified cells of embodiment 1, wherein the population of modified cells includes a modified cell expressing an antigen binding domain for expanding and/or maintaining the modified cells and a modified cell expressing at least two antigen binding domains, a first antigen binding domain for expanding and/or maintaining the modified cells and a second antigen binding domain for killing a target cell, and wherein the two different antigen binding domains are expressed on the same modified cell.

6. The population of modified cells of any one of embodiments 1-5, wherein the modified cell is a modified T cell, a modified NK cell, a modified macrophage, or a modified dendritic cell.

7. The population of modified cells of any one of embodiments 1-6, wherein the antigen binding domain for expanding/or and maintaining the modified cells binds the surface antigen of a WBC, and the antigen binding domain for killing a target cell binds a tumor antigen.

8. The population of modified cells of embodiment 7, wherein the WBC is a B cell.

9. The population of modified cells of embodiment 7, wherein the cell surface antigen of the WBC is CD19, CD22, CD20, BCMA, CD5, CD7, CD2, CD16, CD56, CD30, CD14, CD68, CD11b, CD18, CD169, CD1c, CD33, CD38, CD138, or CD13.

10. The population of modified cells of any one of embodiments 1-9, wherein the solid tumor antigen is tMUC1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Ra2, Mesothelin, PSMA, ROR1, VEGFR-II, GD2, FR-α, ErbB2, EpCAM, EGFRvIII, B7-H3, EGFR, or one of those listed in Table 1.

11. The population of modified cells of embodiment 7, wherein the cell surface antigen of the WBC is CD19, CD20, CD22, or BCMA.

12. The population of modified cells of embodiment 7, wherein the cell surface antigen of a B cell is CD19, and the tumor antigen is tMUC1, TSHR, GUCY2C, ACPP, CLDN18.2 (18.2), PSMA, or UPK2.

13. A composition comprising a first population of cells comprising a first CAR binding a first antigen and a second population of cells comprising a second CAR binding a second antigen, wherein the second antigen is a tumor antigen and the first antigen and second antigen are different antigens.

14. The composition of embodiment 13, wherein the first population of cells does not comprise the second CAR, and/or the second population of cells does not comprise the first CAR.

15. The composition of embodiment 14, wherein the composition further comprises a third population of cells comprising the first CAR and the second CAR.

16. The composition of embodiment 13, wherein the second population of cells further comprises the first CAR, and the first population of cells does not comprise the second CAR, or the first population of cells further comprises the second CAR.

17. The composition of embodiment 13, wherein the second population of cells does not comprise the first CAR, and the first population of cells comprises the second CAR.

18. A method of enhancing expansion of the second population of cells, wherein the second population of cells are cells targeting a solid tumor, the method comprising administering an effective amount of the composition of any one of embodiments 13-17 to a subject having a form of cancer associated with or expressing the tumor antigen.

19. A method of enhancing T cell response in a subject or treating a subject having cancer, the method comprising administering an effective amount of the composition of any one of embodiments 13-17 to the subject having a form of cancer associated with or expressing the tumor antigen.

20. A method of enhancing expansion of cells in a subject, the method comprising: contacting cells with a first vector comprising a first nucleic acid sequence encoding a first CAR and a second vector comprising a second nucleic acid sequence encoding a second CAR to obtain the composition of any one of embodiments 13-17, and administering an effective amount of the composition to the subject having a form of cancer associated with or expresses the tumor antigen.

21. A method of enhancing T cell response in a subject in need thereof or treating a subject having cancer, the method comprising: contacting cells with a first vector comprising a first nucleic acid sequence encoding a first CAR and a second vector comprising a second nucleic acid sequence encoding a second CAR to obtain the composition of any one of embodiments 13-17; and administering an effective amount of the composition to the subject having a form of cancer associated with or expressing the tumor antigen.

22. A method of enhancing expansion of cells in a subject, the method comprising: administering an effective amount of the first population of cells of the composition of any one of embodiments 13-17, and administering an effective amount of the second population of cells.

23. The method of any one of embodiments 20-22, wherein the first vector and the second vector comprise lentiviral vectors.

24. The composition or the method of any one of embodiments 13-23, wherein the first or second antigen is or comprises a surface molecule of a white blood cell (WBC), a tumor antigen, or a solid tumor antigen.

25. The composition or the method of any one of embodiments 13-24, wherein the cells are modified T cells, modified NK cells, modified macrophages, or modified dendritic cells.

26. The composition or the method of embodiment 24, wherein the WBC is a granulocyte, a monocyte, or a lymphocyte.

27. The composition or the method of embodiment 26, wherein the WBC is a B cell.

28. The composition or the method of embodiment 27, wherein the cell surface molecule of the WBC is CD19, CD22, CD20, BCMA, CD5, CD7, CD2, CD16, CD56, CD30, CD14, CD68, CD11b, CD18, CD169, CD1c, CD33, CD38, CD138, or CD13.

29. The composition or the method of embodiment 26, wherein the cell surface molecule of the WBC is CD19, CD20, CD22, or BCMA.

30. The composition or the method of embodiment 26, wherein the cell surface molecule of the WBC is CD19.

31. The composition or the method of embodiment 26, wherein the tumor antigen is a solid tumor antigen.

32. The composition or the method of embodiment 26, wherein the solid tumor antigen is tMUC1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Ra2, Mesothelin, PSMA, ROR1, VEGFR-II, GD2, FR-α, ErbB2, EpCAM, EGFRvlll, B7-H3, CLDN18.2, or EGFR.

33. The composition or the method of embodiment 26, wherein the solid tumor antigen is or comprises tMUC1.

34. The composition or the method of any one of embodiments 13-33, wherein the CAR comprises the antigen binding domain, a transmembrane domain, a co-stimulatory domain, and a CD3 zeta domain.

35. The composition or the method of embodiment 34, wherein the co-stimulatory domain comprises the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that specifically binds with CD83, or a combination thereof.

36. The composition or the method of embodiment 34, wherein the co-stimulatory domain of the second CAR comprises or is an intracellular domain of 4-1BB, and the antigen binding domain of the second CAR binds tMUC1; and/or the antigen binding domain of the first CAR binds CD19 and the co-stimulatory domain of the second CAR comprises or is an intracellular domain of CD28.

37. The composition or the method of any one of embodiments 13-36, wherein the first population of cells and/or the second population of cells further comprise a dominant negative form of PD-1.

38. The composition or the method of embodiment 37, wherein the first population of cells comprise a vector encoding the first CAR and the dominant negative form of PD-1.

39. The composition or the method of any one of embodiments 13-38, wherein the first CAR comprises an scFv binding tMUC1, an intracellular domain of 4-1BB or CD28, and a CD3 zeta domain, and the second CAR comprises an scFv binding CD19, an intracellular domain of 4-1BB or CD28, and a CD3 zeta domain.

40. The composition or the method of any one of embodiments 13-39, wherein the first CAR comprises SEQ ID NO: 5, and the second CAR comprise SEQ ID NO: 70.

41. The composition or the method of any one of embodiments 13-40, wherein the second population of cells comprises a lentiviral vector encoding the first CAR and a therapeutic agent and the first population of cells comprises a lentiviral vector encoding the second CAR and a dominant negative form of PD-1.

42. The composition or the method of any one of embodiments 13-41, wherein the first population of cells comprise the first CAR and a therapeutic agent and the second population of cells comprise the second CAR and a dominant negative form of PD-1.

43. The composition or the method of embodiment 41 or 42, wherein the therapeutic agent comprises or is a cytokine.

44. The composition or the method of embodiment 43, wherein the cytokine is IL6 and/or INFγ.

45. A method comprising administering an effective amount of a first population of T cells comprising a CAR comprising an scFv binding CD19, an intracellular domain of 4-1BB or CD28, and a CD3 zeta domain to a subject, thereby enhancing expansion of the first population of T cells in the subject; and administering an effective amount of a second population of T cells comprising a CAR comprising an scFv binding tMUC1, an intracellular domain of 4-1BB or CD28, and a CD3 zeta domain to the patient.

46. The method of embodiment 45, wherein the first population of cells further comprises an additional CAR comprising the scFv binding tMUC1, the intracellular domain of 4-1BB or CD28, and the CD3 zeta domain.

47. The method of embodiment 45, wherein the second population of cells does not comprise the scFv binding CD19.

48. The method of embodiment 45, wherein the first population of cells does not comprise the scFv binding tMUC1.

49. A method for enhancing treatment of a subject with cancer, the method comprising: administering to the subject with CAR T cells targeting an antigen of WBC; and administering to the subject tumor-infiltrating lymphocytes (TILs).

50. A method for expanding TILs in a subject with cancer, the method comprising: administering to the subject with CAR T cells targeting an antigen of WBC; and administering to the subject tumor-infiltrating lymphocytes (TILs).

51. The method of embodiment 49 or 50, wherein the TILs are prepared by:
(i) obtaining a first population of TILs from a tumor resected from the subject;
(ii) performing a first expansion by culturing the first population of TILs in a cell culture medium comprising IL-2 to produce a second population of TILs;
(iii) performing a second expansion by supplementing the cell culture medium of the second population of TILs with additional IL-2, OKT-3, and antigen-presenting cells (APCs), to produce a third population of TILs, wherein the third population of TILs is at least 100-fold greater in number than the second population of TILs, and wherein the second expansion is performed for at least 14 days in order to obtain the third population of TILs, wherein the third population of TILs is a therapeutic population of TILs which comprises an increased subpopulation of effector T cells and/or central memory T cells relative to the second population of TILs; and
(iv) administering a therapeutically effective dosage of the third population of TILs to the subject.

52. The method of embodiment 51, wherein the method further comprises prior to step (iv) a step of performing an additional second expansion by supplementing the cell culture medium of the third population of TILs with additional IL-2, additional OKT-3, and additional APCs, wherein the additional second expansion is performed for at least 14 days to obtain a larger therapeutic population of TILs than obtained in step (iii), wherein the larger therapeutic population of TILs comprises an increased subpopulation of effector T cells and/or central memory T cells relative to the third population of TILs.

53. The method of embodiment 51, wherein after step (ii) the cells are removed from the cell culture medium and cryopreserved in a storage medium prior to the second expansion of embodiment 51.

54. The method of embodiment 53, wherein the cells are thawed prior to the second expansion of embodiment 51.

55. The method of embodiment 51, wherein step (iii) is repeated one to four times in order to obtain sufficient TILs in the therapeutic population of TILs for a therapeutically effective dosage of the TILs.

56. The method of any one of embodiments 49 to 55, wherein the APCs are peripheral blood mononuclear cells (PBMCs).

57. The method of any one of embodiments 49 to 55, wherein the effector T cells and/or central memory T cells exhibit one or more characteristics selected from the group consisting of expression of CD27, expression of CD28, longer telomeres, increased CD57 expression, and decreased CD56 expression, relative to effector T cells and/or central memory T cells in the third population of cells.

58. The method of any one of embodiments 49 to 55, wherein the effector T cells and/or central memory T cells exhibit increased CD57 expression and decreased CD56 expression, relative to effector T cells and/or central memory T cells in the third population of cells.

59. The method of any one of embodiments 49 to 55, wherein the cancer is selected from the group consisting of melanoma, cervical cancer, head and neck cancer, glioblastoma, ovarian cancer, sarcoma, pancreatic cancer, bladder cancer, breast cancer, triple-negative breast cancer, and non-small cell lung carcinoma.

60. The method of any one of embodiments 49-59, wherein the CAR binds CD19, CD20, CD22, or BCMA.

61. The method of any one of embodiments 49-60, wherein a number of TILs in a subject infused with both CAR T cells and TILs is more than the number of TILs in a subject infused with TILS.

Figure 2:
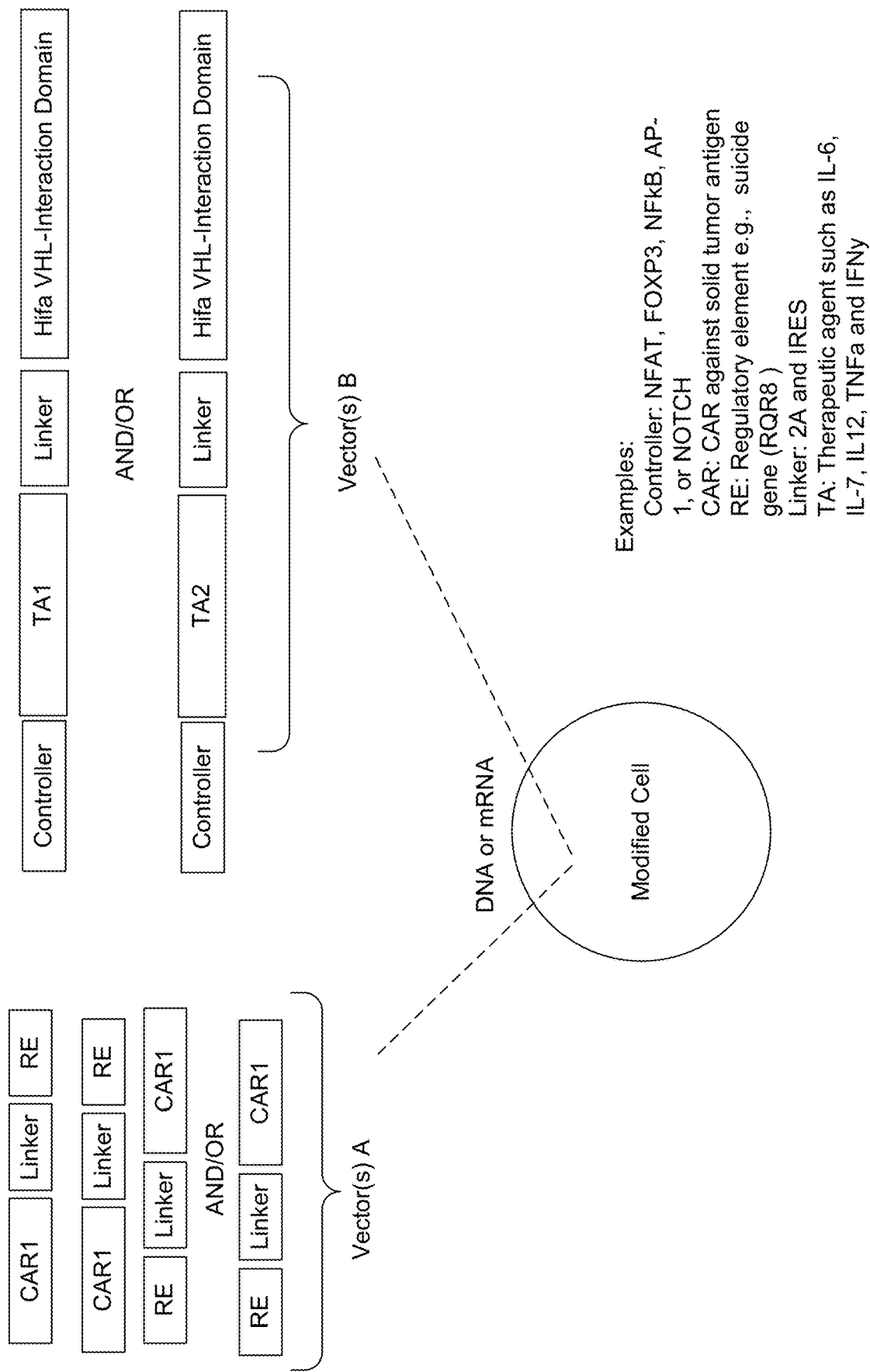
FIG. 2 is another schematic diagram of exemplary modified cells.
Figure 3:
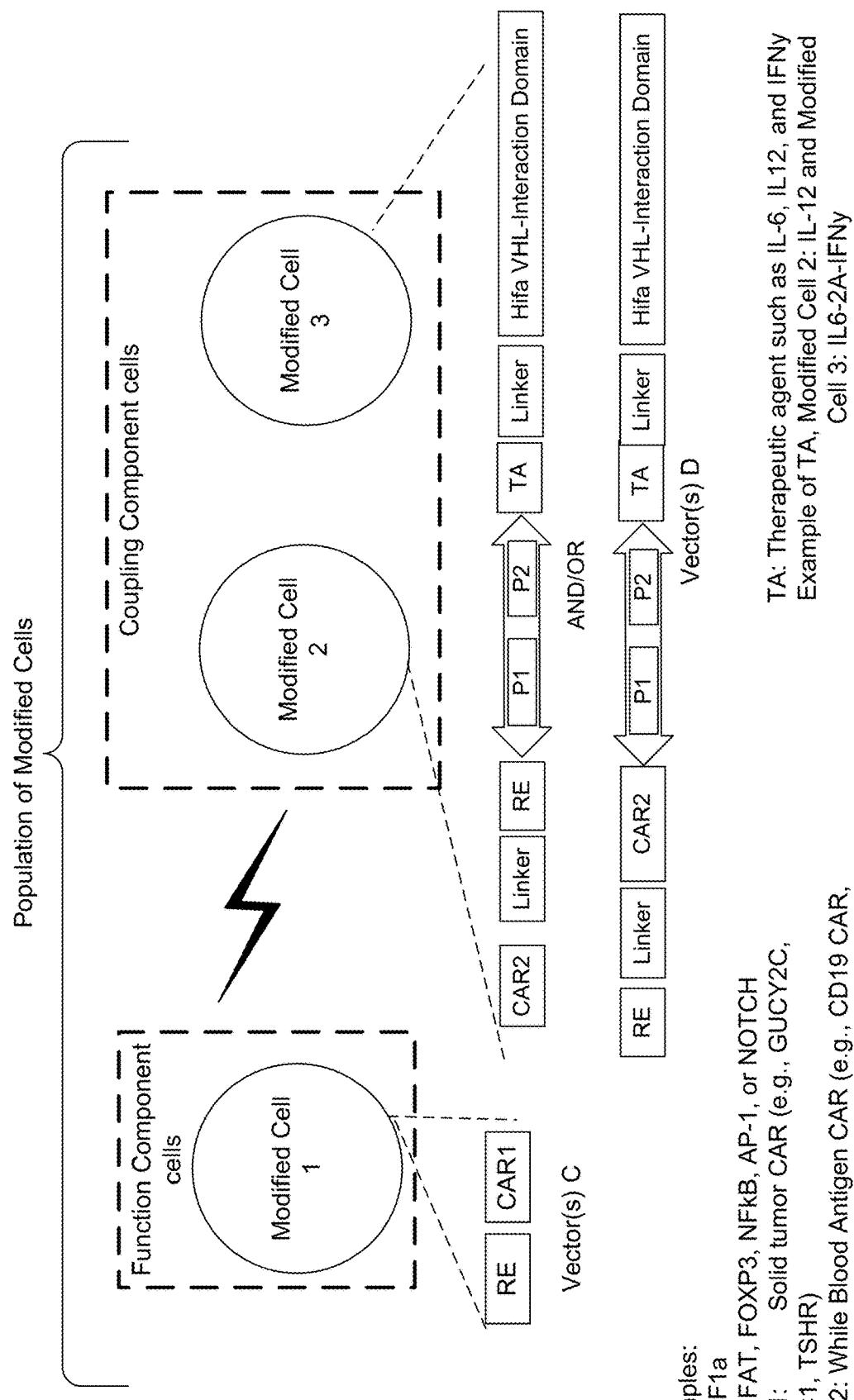
FIG. 3 is a schematic diagram of a therapeutic system comprising a population of modified cells.
Figure 4:
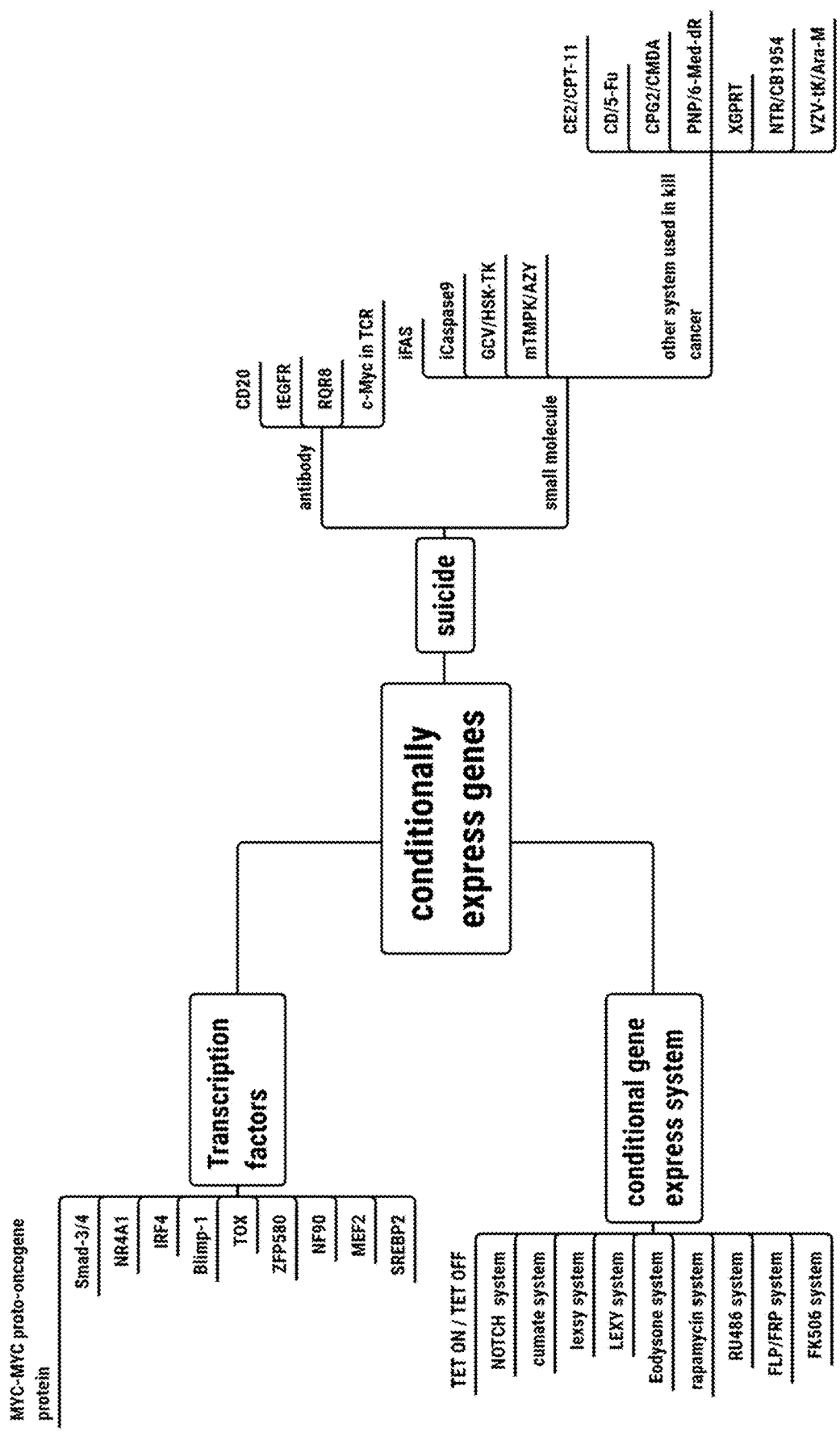
FIG. 4 shows examples of conditional gene expression systems.

62. The method of any one of embodiments 49-60, wherein the CAR T cells comprise the modified cell of FIG. 1 or 2.

63. A method of enhancing expansion of cells in a subject in need thereof or treating a subject having cancer, the method comprising: administering an effective amount of a composition to the subject having a form of cancer expressing a tumor antigen, the composition comprising a first population of cells comprising a first CAR binding a first antigen, and a second population of cells comprising a second CAR binding a second antigen, wherein the second antigen is a tumor antigen and is different from the first antigen.

64. The method of embodiment 63, wherein the cells are T cells, NK cells, or dendritic cells.

65. The method of embodiment 63, wherein the first antigen comprises a cell surface molecule of a white blood cell (WBC), a tumor antigen, or a solid tumor antigen.

66. The method of embodiment 65, wherein the WBC is a granulocyte, a monocyte, or lymphocyte.

67. The method of embodiment 66, wherein the lymphocyte is a B cell.

68. The method of embodiment 65, wherein the cell surface molecule of the WBC is CD19, CD22, CD20, BCMA, CD5, CD7, CD2, CD16, CD56, CD30, CD14, CD68, CD11b, CD18, CD169, CD1c, CD33, CD38, CD138, or CD13.

69. The method of embodiment 65, wherein the cell surface molecule of the WBC is CD19, CD20, CD22, or BCMA.

70. The method of embodiment 65, wherein the cell surface molecule of the WBC is CD19.

71. The method of embodiment 63, wherein the tumor antigen is a solid tumor antigen.

72. The method of embodiment 71, wherein the solid tumor antigen is tMUC1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Ra2, Mesothelin, PSMA, ROR1, VEGFR-II, GD2, FR-α, ErbB2, EpCAM, EGFRvlll, B7-H3, CLDN18.2, or EGFR.

73. The method of embodiment 71, wherein the solid tumor antigen comprises tMUC1.

74. The method of embodiment 63, wherein the CAR comprises an antigen binding domain, a transmembrane domain, a co-stimulatory domain, and a CD3 zeta domain.

75. The method of embodiment 74, wherein the co-stimulatory domain comprises the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that binds CD83, or a combination thereof.

76. The method of embodiment 63, wherein the first CAR comprises an scFv binding CD19, an intracellular domain of 4-1BB or CD28, and a CD3 zeta domain, and the second CAR comprises an scFv binding tMUC1, an intracellular domain of 4-1BB or CD28, and a CD3 zeta domain.

77. The method of embodiment 63, wherein an antigen binding domain of the first CAR comprises SEQ ID NO: 5 and an antigen binding domain of the second CAR comprises SEQ ID NO: 70.

78. The method of embodiment 63, wherein the second population of cells comprises a lentiviral vector encoding the second CAR and a dominant negative form of PD-1.

79. The method of embodiment 63, wherein the first population of cells comprises a lentiviral vector encoding the first CAR and a therapeutic agent.

80. The method of embodiment 79, wherein the therapeutic agent comprises a cytokine.

81. The method of embodiment 80, wherein the cytokine is IL6 and/or INFγ.

82. The method of embodiment 80, wherein the cytokine is at least one of IL6, IL12, IL7, IL15, TNF-α, or IFNγ.

83. A method for in vitro cell preparation, the method comprising: contacting cells with (1) a first vector comprising a polynucleotide encoding a first antigen binding molecule that binds a first antigen and (2) a second vector comprising a polynucleotide encoding a second antigen binding molecule that binds a second antigen to obtain a population of modified cells, to obtain a mixed population of modified cells, wherein the first antigen is different from the second antigen.

84. A method for enhancing cell expansion in a subject having cancer, the method comprising: obtaining cells from the subject or a healthy donor; contacting the cells with (1) a first vector comprising a polynucleotide encoding a first antigen binding molecule that binds a first antigen and (2) a second vector comprising a polynucleotide encoding a second antigen binding molecule that binds a second antigen to obtain a mixed population of modified cells, and administering an effective amount of the mixed population of modified cells to the subject; wherein: the first antigen is different from the second antigen, and a level of the cell expansion in the subject is higher than a level of the cell expansion in a subject administered an effective amount of a population of modified cells that have been contacted with the first vector but not the first vector.

85. A method for treating a subject having cancer, the method comprising: obtaining cells from the subject or a healthy donor; contacting the cells with (1) a first vector comprising a polynucleotide encoding a first antigen binding molecule that binds a first antigen and (2) a second vector comprising a polynucleotide encoding a second antigen binding molecule that binds a second antigen to obtain a mixed population of modified cells, and administering an effective amount of the mixed population of modified cells to the subject; wherein: the first antigen is different from the second antigen.

86. A method for enhancing treatment of a subject having cancer, the method comprising: obtaining cells from the subject or a healthy donor; contacting the cells with (1) a first vector comprising a polynucleotide encoding a first antigen binding molecule that binds a first antigen and (2) a second vector comprising a polynucleotide encoding a second antigen binding molecule that binds a second antigen to obtain a mixed population of modified cells, and administering an effective amount of the mixed population of modified cells to the subject; wherein: the first antigen is different from the second antigen, and a level of inhibition of tumor growth in the subject is higher than a level of inhibition of tumor growth in a subject administered with an effective amount of a population of modified cells that have been contacted with the second vector but not the first vector.

87. A method for in vitro cell preparation, the method comprising: introducing a first vector comprising a polynucleotide encoding a first antigen binding molecule that binds a first antigen into a first population of cells, and introducing a second vector comprising a polynucleotide encoding a second antigen binding molecule that binds a second antigen into a second population of cells, and culturing the first and second population of cells separately; wherein the first antigen is different from the second antigen.

88. A method for enhancing cell expansion in a subject having cancer, the method comprising: introducing a first vector comprising a polynucleotide encoding a first antigen binding molecule that binds a first antigen into a first population of cells to obtain a first population of modified cells; introducing a second vector comprising a polynucleotide encoding a second antigen binding molecule that binds a second antigen into a second population of cells to obtain a second population of modified cells, and administering an effective amount of the first and second population of modified cells to the subject; wherein: the first antigen is different from the second antigen, and a level of the cell expansion in the subject is higher than a level of the cell expansion in a subject administered an effective amount of the second population of modified cells but not the first population of modified cells. In embodiments, the first population of modified cells and the second population of modified cells are administered simultaneously or sequentially.

89. A method for treating a subject having cancer, the method comprising: introducing a first vector comprising a polynucleotide encoding a first antigen binding molecule that binds a first antigen into a first population of cells to obtain a first population of modified cells; introducing a second vector comprising a polynucleotide encoding a second antigen binding molecule that binds a second antigen into a second population of cells to obtain a second population of modified cells, and administering an effective amount of the first and second population of modified cells to the subject; wherein the first antigen is different from the second antigen. In embodiments, the first population of modified cells and the second population of modified cells are administered simultaneously or sequentially.

90. A method for enhancing treatment of a subject having cancer, the method comprising: introducing a first vector comprising a polynucleotide encoding a first antigen binding molecule that binds a first antigen into a first population of cells to obtain a first population of modified cells; introducing a second vector comprising a polynucleotide encoding a second antigen binding molecule that binds a second antigen into a second population of cells to obtain a second population of modified cells; and administering an effective amount of the first and second population of modified cells to the subject, wherein: the first antigen is different from the second antigen, and a level of inhibition of tumor growth in the subject is higher than a level of inhibition of tumor growth in a subject administered with an effective amount of the second population of modified cells in the absence of the first population of modified cells. In embodiments, the first population of modified cells and the second population of modified cells are administered simultaneously or sequentially.

91. A method for enhancing T cell response, the method comprising: introducing a first vector comprising a polynucleotide encoding a first antigen binding molecule that binds a first antigen into a first population of cells; introducing a second vector comprising a polynucleotide encoding a second antigen binding molecule that binds a second antigen into a second population of cells; contacting cells expressing the second antigen with the first population of cells and the second population of cells, and measuring a level of the T cell response, wherein the level of T cell response is higher in the contacted cells than a level of the T cell response in cells contacted with the second population of cells without the first population of cells. In embodiments, at least the first population of modified cells are derived from a healthy donor. For example, the modified cells have a reduced expression of the endogenous TRAC gene. In these instances, the first population of modified cells may be generated in a large amount and used to infuse multiple subjects. Because the first population of modified cells is derived from a healthy donor, these cells will be removed by the immune system of a subject having the caner who is infused with the mixed cells. In embodiments, the mixed cells comprise the first population modified cells derived from a healthy donor and the second population of modified cells derived from the subject having cancer such that the first population of modified cells will be gradually removed after eliciting or causing cell expansion of the second population of modified cells, while the second population of modified may continue to inhibit tumor cells.

92. A method for enhancing T cell response, the method comprising: contacting a population of cells with a first vector comprising a polynucleotide encoding a first antigen binding molecule that binds a first antigen and a second vector comprising a polynucleotide encoding a second antigen binding molecule that binds a second antigen to obtain a mixed population of modified cells; contacting cells expressing the second antigen with the mixed population of modified cells; and measuring a level of the T cell response, wherein the level of T cell response is higher in the contacted cells than a level of the T cell response in cells contacted with the population of cells contacted with the second vector without the first vector.

93. The method of any one of embodiments 83-92, wherein the cells are T cells, NK cells, or dendritic cells. In embodiments, the cells T cells.

94. The method of any one of embodiments 83-93, wherein the first antigen binding molecule binds a cell surface molecule of a WBC.

95. The method of embodiment 94, wherein the WBC is a granulocyte, a monocyte, or lymphocyte.

96. The method of embodiment 94, wherein the WBC is a B cell.

97. The method of embodiment 94, wherein the cell surface molecule of the WBC is CD19, CD22, CD20, BCMA, CD5, CD7, CD2, CD16, CD56, CD30, CD14, CD68, CD11b, CD18, CD169, CD1c, CD33, CD38, CD138, or CD13.

98. The method of embodiment 94, wherein the cell surface molecule of the WBC is CD19, CD20, CD22, or BCMA.

99. The method of embodiment 94, wherein the cell surface molecule of the WBC is CD19.

100. The method of any one of embodiments 83-99, wherein the second antigen binding molecule binds to a solid tumor antigen.

101. The method of embodiment 100, wherein the solid tumor antigen is tMUC1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Ra2, Mesothelin, PSMA, ROR1, VEGFR-II, GD2, FR-α, ErbB2, EpCAM, EGFRvlll, CLDN18.2, or EGFR.

102. The method of any one of embodiments 83-101, wherein the first and second binding molecules are CARs.

103. The method of embodiment 102, wherein the CAR comprises an extracellular domain, a transmembrane domain, and an intracellular domain, and the extracellular domain binds a tumor antigen.

104. The method of embodiment 103, wherein the intracellular domain comprises a co-stimulatory domain that comprises an intracellular domain of a co-stimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, or a combination thereof.

105. The method of embodiment 105, wherein the intracellular domain comprises a CD3 zeta signaling domain.

106. The method of any one of embodiments 83-101, wherein the first binding molecule is a CAR, and the second binding molecule is a TCR.

107. The method of embodiment 106, wherein the T cell comprises a modified T Cell Receptor (TCR).

108. The method of embodiment 106, wherein the TCR is derived from spontaneously occurring tumor-specific T cells in patients.

109. The method of embodiment 106, wherein the TCR binds a tumor antigen.

110. The method of embodiment 109, wherein the tumor antigen comprises CEA, gp100, MART-1, p53, MAGE-A3, or NY-ESO-1.

111. The method of embodiment 106, wherein the TCR comprises TCRγ and TCRδ chains, TCRα and TCRβ chains, or a combination thereof.

112. The method of embodiment 106, wherein the second population of cells are derived from TILs.

113. The method of any one of embodiments 83-112, wherein the population of modified cells comprise cells comprising the first binding molecule and cells comprising the second binding molecules.

114. The method of any one of embodiments 83-112, wherein the population of modified cells comprise cells comprising the first binding molecule, cells comprising the second binding molecules, and cells comprising both the first binding molecule and the second binding molecule.

115. The method of any one of embodiments 83-112, wherein the T cell response is measured by the number of copies of CAR(s) and/or the amount of cytokine released. In embodiments, the cytokine released are IL-6 and/or IFNγ.

116. The method of any one of embodiments 83-112, wherein the T cell response comprises cytokine release, cell expansion, and/or activation levels.

117. The method of any one of embodiments 83-112, wherein the first vector further comprises a polynucleotide encoding IL-6, IFNγ, or a combination thereof.

118. The method of any one of embodiments 83-112, wherein the first vector further comprises a polynucleotide encoding IL-12.

119. The method of any one of embodiments 116 and 117, wherein the polynucleotide comprises a polynucleotide encoding NFAT and/or VHL.

120. The method of any one of embodiments 83-119, wherein the population of modified cells comprise cells expressing the first binding molecule and IL-6, IFNγ, or a combination thereof, cells expressing the second binding molecules, cells expressing the first and second molecules, and/or cells expressing the first binding molecule and IL-12.

121. The method of any one of embodiments 83-120, wherein the population of modified cells comprise cells expressing the second binding molecule and IL-6, IFNγ, or a combination thereof, cells expressing the second binding molecules, cells expressing the first and second molecules, and/or cells expressing the first binding molecule and IL-12.

122. The method of any one of embodiments 83-121, wherein the population of modified cells comprise cells expressing the second binding molecule and IL-6, IFNγ, or a combination thereof, cells expressing the second binding molecule, cells expressing the first and second molecules, and/or cells expressing the second binding molecule and IL-12.

123. The method of any one of embodiments 83-122, wherein the population of modified cells comprise cells expressing a dominant negative form of PD-1.

124. A bispecific chimeric antigen receptor, comprising: a first antigen binding domain, a second antigen binding domain, a cytoplasmic domain, and transmembrane domain, wherein the first antigen binding domain recognizes a first antigen, and the second antigen binding domain recognizes a second antigen, and the first antigen is different from the second antigen.

125. The bispecific chimeric antigen receptor of embodiment 124, wherein the first antigen and the second antigen are not expressed on the same cell.

126. The bispecific chimeric antigen receptor of embodiment 124 or 125, wherein the first antigen is an antigen of a blood component, and the second antigen is an antigen of a solid tumor.

127. The bispecific chimeric antigen receptor of any one of embodiments 124-126, wherein the first antigen is CD19, and the second antigen is a tumor-associated MUC1.

128. The bispecific chimeric antigen receptor of any one of embodiments 124-128, wherein the first antigen binding domain comprises amino acid sequence SEQ ID: 5 or 6.

129. The bispecific chimeric antigen receptor of any one of embodiments 124-128, wherein the second antigen binding domain comprises one of amino acid sequence SEQ ID: 70, 71, 72, 79, 80, or 81.

130. The bispecific chimeric antigen receptor of embodiment 124, wherein the CAR comprises the amino acid sequence of any one of tanCARs.

131. The bispecific chimeric antigen receptor of embodiment 124, wherein the first binding domain binds an antigen of nonessential tissues, and the second binding domain binds an antigen of tumor tissue. In embodiments, the first binding domain binds TSHR or GUCY2C. In embodiments, the second binding domain binds tMUC1, MAGE-E1, or Epithelial tumor antigen (ETA).

132. The bispecific chimeric antigen receptor of embodiment 124, wherein the first binding domain binds a tissue-specific antigen, and the second binding domain binds an antigen expressed on more than one tissue. In embodiments, the first binding domain binds TSHR or PRLR. In embodiments, the second binding domain binds tMUC1, MAG-E1, or ETA.

133. The bispecific chimeric antigen receptor of embodiment 124, wherein the first binding domain binds an antigen of normal tissue, and the second binding domain binds an antigen expressed on tumor tissue. In embodiments, the first binding domain binds ACPP, TSHR, GUCY2C, UPK2, CLDN18.2, PSMA, DPEP3, CXCR5, B7-H3, MUC16, SIGLEC-15, CLDN6, Muc17, PRLR, or FZD10. In embodiments, the second binding domain binds tMUC1, MAG-E1, or ETA.

134. The bispecific chimeric antigen receptor of any one of embodiments 123, wherein the first binding domain binds to an antigen that is expressed on non-malignant cells, and the second binding domain binds an antigen that is expressed on tumor cells and not on corresponding non-malignant cells.

135. A cell comprising the bispecific CAR of any one of embodiments 123-134.

136. A nucleic acid encoding the bispecific CAR of any one of embodiments 123-134.

137. A method of enhancing T cell response, enhancing treatment of cancer, treating cancer in a subject, treating a subject having a tumor, or inhibiting the growth of a tumor, the method comprising: administering an effective amount of cell of embodiment 135.

136. The use of the cell, the bispecific CAR, population of modified cells, the composition, or the method of any one of embodiments 1-135 for the treatment of a subject in need thereof.

137. The use of the cell, the bispecific CAR, population of modified cells, the composition, or the method of embodiment 136, wherein the subject has cancer.

138. The method for treating a subject having cancer of any preceding embodiments, wherein the first population of modified cells is T cells comprising the CAR targeting the WBC antigen (e.g., CD19), and/or the second population of modified cells are T cells comprising the CAR targeting the solid tumor antigen.

139. The method of embodiment 138, wherein the first population of modified cells comprise a suicide gene (e.g., RQR8).

140. The method of embodiment 139, the method further comprising: activating the suicide gene to reduce a number of the first population of modified cells at a predetermined time after the cell infusion or in response to the subject's response.

141. A polynucleotide comprising an NFAT promoter, a nucleotide sequence encoding therapeutic agent, and/or a nucleotide sequence encoding a VHL-interaction domain of HIF1α, wherein the therapeutic agent comprises at least one of IL-12, IL-6, IL-7, IL-2, IL-15, IL-23, GCSF, CCL19, and GM-CSF.

142. A polynucleotide comprising a promoter corresponding to Hif1a, NFAT, FOXP3, or NFKB, a nucleotide sequence encoding a therapeutic agent, and a nucleotide sequence encoding an oxygen-sensitive polypeptide domain.

143. The polynucleotide of embodiment 142, wherein the oxygen-sensitive polypeptide domain is HIFI alpha, HIF3 alpha, or a polypeptide comprising an amino acid sequence having a sequence identity of over 80%, 90%, or 95% with respectively Hif VHL-interaction domain, Hif amino acid 344-417, or Hif amino acid 380-603.

144. The polynucleotide of embodiment 142, wherein the oxygen-sensitive polypeptide domain comprises HIF VHL binding domain.

145. The polynucleotide of any of embodiments 142-144, wherein the therapeutic agent comprises or is a cytokine.

146. The polynucleotide of any of embodiments 142-144, wherein the therapeutic agent comprises or is IL-1P, IL-2, IL-4, IL-5, IL-6, IL-8, IL-10, IL-12, IL-13, IL-15, IL-17, IL-1Ra, IL-2R, IFN-γ, IFN-γ, MIP-In, MIP-IP, MCP-1, TNFα, GM-CSF, GCSF, CXCL9, CXCL10, CXCR factors, VEGF, RANTES, EOTAXIN, EGF, HGF, FGF-P, CD40, CD40L, ferritin, and any combination thereof. In embodiments, the cytokines include proinflammatory cytokines such as IFN-γ, IL-15, IL-4, IL-10, TNFα, IL-8, IL-5, IL-6, GM-CSF, CCL19, and/or MIP-Iα.

147. The polynucleotide of any of embodiments 142-144, wherein the therapeutic agent comprises or is IL-12, IL-6, IL-7, IL-15, IL-23, GCSF, and/or GM-CSF.

148. A kit comprising an effective amount of vector-free nucleic acids comprising the polynucleotide of any preceding embodiments to render a population of immune cells specific for a tumor antigen expressed on the surface of the cells of a subject.

149. A method or use of polynucleotide, the method comprising providing a viral particle (e.g., AAV, lentivirus or their variants) comprising a vector genome, the vector genome comprising the polynucleotide and a polynucleotide encoding an antigen binding molecule, the polynucleotide operably linked to an expression control element conferring transcription of the polynucleotides; and administering an amount of the viral particle to a subject such that the polynucleotide is expressed in the subject, where the one or more molecules are overexpressed in cancer cells, associated with recruitment of immune cells, and/or associated with autoimmunity.

150. The method of embodiment 149, wherein the AAV preparation may include AAV vector particles, empty capsids, and host cell impurities, thereby providing an AAV product substantially free of AAV empty capsids.

151. A modified cell comprising the polynucleotide of any of embodiments 141-147.

152. The modified cell of any of the preceding embodiments, wherein the modified cell comprises the antigen binding molecule, the antigen binding molecule is a chimeric antigen receptor (CAR), which comprises an antigen-binding domain, a transmembrane domain, and an intracellular signaling domain.

153. The modified cell of embodiment 152, wherein the antigen-binding domain binds to a tumor antigen is selected from a group consisting of: TSHR, CD19, CD123, CD22, CD30, CD171, CS-1, CLL-1, CD33, EGFRvlll, GD2, GD3, BCMA, Tn Ag, PSMA, ROR1, FLT3, FAP, TAG72, CD38, CD44v6, CEA, EPCAM, B7H3, KIT, IL-13Ra2, Mesothelin, IL-11Ra, PSCA, PRSS21, VEGFR2, LewisY, CD24, PDGFR-beta, SSEA-4, CD20, Folate receptor alpha, ERBB2 (Her2/neu), MUC1, EGFR, NCAM, Prostase, PAP, ELF2M, Ephrin B2, IGF-I receptor, CAIX, LMP2, gp100, bcr-abl, tyrosinase, EphA2, Fucosyl GM1, sLe, GM3, TGS5, HMWMAA, o-acetyl-GD2, Folate receptor beta, TEM1/CD248, TEM7R, CLDN6, GPRC5D, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, NY-ESO-1, LAGE-1a, MAGE-A1, legumain, HPV E6, E7, MAGE A1, ETV6-AML, sperm protein 17, XAGE1, Tie 2, MAD-CT-1, MAD-CT-2, Fos-related antigen 1, p53, p53 mutant, prostein, survivin and telomerase, PCTA-1/Galectin 8, MelanA/

MART1, Ras mutant, hTERT, sarcoma translocation breakpoints, ML-IAP, ERG (TMPRSS2 ETS fusion gene), NA17, PAX3, Androgen receptor, Cyclin B1, MYCN, RhoC, TRP-2, CYP1B1, BORIS, SART3, PAX5, OY-TES1, LCK, AKAP-4, SSX2, RAGE-1, human telomerase reverse transcriptase, RU1, RU2, intestinal carboxyl esterase, mut hsp70-2, CD79a, CD79b, CD72, LAIR1, FCAR, LILRA2, CD300LF, CLEC12A, BST2, EMR2, LY75, GPC3, FCRL5, and IGLL1.

154. The modified cell of any one of embodiments 152 and 153, wherein the intracellular signaling domain comprises a co-stimulatory signaling domain, or a primary signaling domain and a co-stimulatory signaling domain, wherein the co-stimulatory signaling domain comprises a functional signaling domain of a protein selected from the group consisting of CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, a ligand that specifically binds with CD83, CDS, ICAM-1, GITR, BAFFR, HVEM (LIGHTR), SLAMF7, NKp80 (KLRF1), CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, NKp44, NKp30, NKp46, and NKG2D 155. The modified cell of any of proceeding embodiments, wherein the modified cell comprises the antigen binding molecule, and the antigen binding molecule is a modified TCR.

156. The modified cell of embodiment 155, wherein the TCR is derived from spontaneously occurring tumor-specific T cells in patients.

157. The modified cell of embodiment 156, wherein the TCR binds to a tumor antigen.

158. The modified cell of embodiment 157, wherein the tumor antigen comprises CEA, gp100, MART-1, p53, MAGE-A3, or NY-ESO-1.

159. The modified cell of embodiment 157, wherein the TCR comprises TCRγ and TCRδ Chains or TCRα and TCRβ chains, or a combination thereof.

160. The modified cell of any of the preceding embodiments, wherein the cell is an immune cell (e.g., a population of immune effector cells), and/or the immune cell is a T cell or an NK cell.

161. The modified cell of embodiment 160, wherein the immune effector cell is a T cell.

162. The modified cell of embodiment 161 wherein the T cell is a CD4+ T cell, a CD8+ T cell, or a combination thereof.

163. The modified cell of any of the preceding embodiments, wherein the cell is a human cell.

164. The modified cell of any proceeding embodiments, wherein the modified cell comprises a nucleic acid sequence encoding a binding molecule and a dominant negative form of an inhibitory immune checkpoint molecule or a receptor thereof.

165. The modified cell of embodiment 164, wherein the inhibitory immune checkpoint molecule is selected from the group consisting of programmed death 1 (PD-1), cytotoxic T lymphocyte antigen-4 (CTLA-4), B- and T-lymphocyte attenuator (BTLA), T cell immunoglobulin mucin-3 (TIM-3), lymphocyte-activation protein 3 (LAG-3), T cell immunoreceptor with Ig and ITIM domains (TIGIT), leukocyte-associated immunoglobulin-like receptor 1 (LAIRI), natural killer cell receptor 2B4 (2B4), and CD 160.

166. The modified cell embodiment 164, wherein inhibitory immune checkpoint molecule is modified PD-1.

167. The modified cell of embodiment 166, wherein the modified PD-1 lacks a functional PD-1 intracellular domain for PD-1 signal transduction, interferes with a pathway between PD-1 of a human T cell of the human cells and PD-L1 of a certain cell, comprises or is a PD-1 extracellular domain or a PD-1 transmembrane domain, or a combination thereof, or a modified PD-1 intracellular domain comprising a substitution or deletion as compared to a wild-type PD-1 intracellular domain, or comprises or is a soluble receptor comprising a PD-1 extracellular domain that binds to PD-L1 of a certain cell.

168. The modified cell of any proceeding embodiments, wherein the modified cell is engineered to express and secrete a therapeutic agent such as a cytokine, and/or the therapeutic agent that is or comprises IL-6 or IFN-γ, or a combination thereof.

169. The modified cell of embodiment 168, wherein the therapeutic agent that is or comprises IL-15 or IL-12, or a combination thereof, the small protein or the therapeutic agent is or comprises a recombinant or native cytokine, and/or the small protein is or comprises IL-12, IL-6 or IFN-γ.

170. The modified cell of any proceeding embodiments, wherein the modified cell is derived from a healthy donor or the subject having cancer.

171. The modified cell of embodiment 170, wherein the modified cell has a reduced expression of endogenous TRAC gene.

172. The modified cell of any proceeding embodiments, wherein the modified cell comprises a first CAR binding a white blood antigen and a second CAR binding a solid tumor antigen.

173. The modified cell of any proceeding embodiments, wherein the modified cell comprises a bispecific CAR binding a white blood antigen and a solid tumor antigen.

174. A pharmaceutical composition comprising a population of the modified cells of embodiments 141-173 and a population of additional modified cells, wherein the modified cells bind a first antigen, and the additional modified cells bind a second antigen, which is different from the first antigen.

175. The pharmaceutical composition of embodiment 174, wherein the first antigen is a white blood cell antigen, and the second antigen is a solid tumor antigen.

176. The pharmaceutical composition of embodiment 174, wherein the second antigen is a white blood cell antigen, and the first antigen is a solid tumor antigen.

177. The pharmaceutical composition of embodiments 175 or 176, wherein the white blood cell antigen is CD19, CD22, CD20, BCMA, CD5, CD7, CD2, CD16, CD56, CD30, CD14, CD68, CD11b, CD18, CD169, CD1c, CD33, CD38, CD138, or CD13.

178. The pharmaceutical composition of embodiments 175 or 176, wherein is CD19, CD20, CD22, or BCMA.

179. The pharmaceutical composition of embodiments 175 or 176, wherein the solid tumor antigen is tMUC 1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, CLDN18.2, QRFPR, GPR119, CLDN6, UPK2, ADAM12, SLC45A3, ACPP, MUC21, MUC16, MS4A12, ALPP, CEA, EphA2, FAP, GPC3, IL13-Ra2, Mesothelin, PSMA, ROR1, VEGFR-II, GD2, FR-α, ErbB2, EpCAM, EGFRvlll, B7-H3, or EGFR.

180. The pharmaceutical composition of embodiments 175 or 176, wherein the solid tumor antigen comprises tumor associated MUC1, ACPP, TSHR, GUCY2C, UPK2, CLDN18.2, PSMA, DPEP3, CXCR5, B7-H3, MUC16, SIGLEC-15, CLDN6, Muc17, PRLR, and FZD10.

181. A method of eliciting or enhancing T cell response, treating a subject in need thereof or enhancing cancer treatment thereof, the method comprising administering an effective amount of the pharmaceutical composition of any of embodiments 174-180.

182. The modified cell or the method of any proceeding embodiments, wherein the solid tumor antigen is ACPP, and the cancer is prostate.

Figure 5:
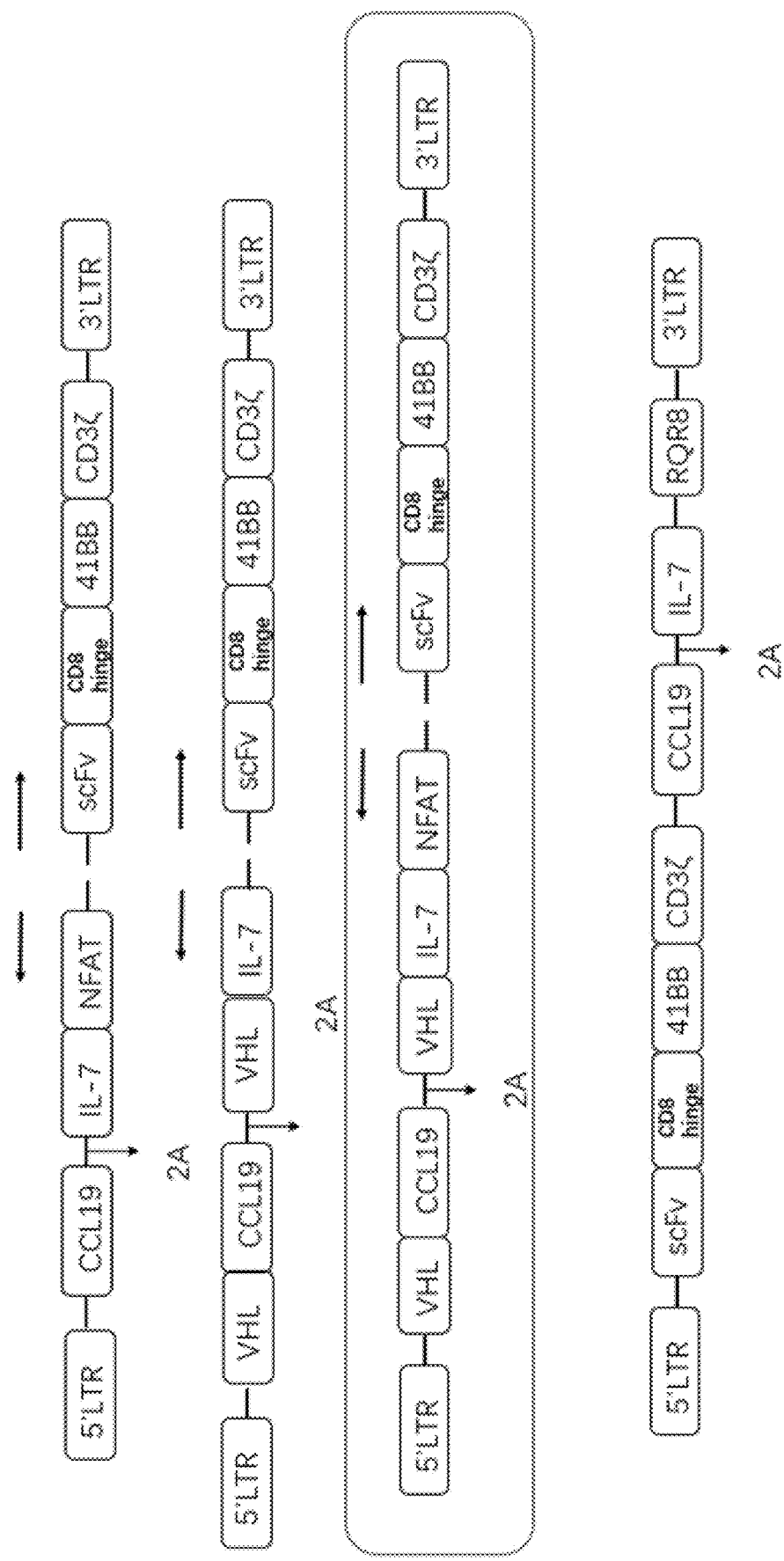
FIG. 5 shows various constructs of vectors for cellular and gene therapies.

183. The modified cell or the method of any proceeding embodiments, wherein the therapeutic agent is IL-7 or CCL19, or a combination thereof (See Embodiments in FIG. 5).

184. The modified cell or the method of embodiment 183, wherein the modified cell comprises at least one of the SEQ ID NO: 505-512.

185. The binding molecule and/or therapeutic agent of any proceeding embodiments, wherein the binding molecule and/or therapeutic agent is associated with a suicide gene.

186. The polynucleotide of any proceeding embodiments, wherein the polynucleotide comprises a suicide gene.

187. The polynucleotide of embodiment 186, wherein the suicide gene is RQR8.

188. A method for treating a subject having lymphoma, enhancing the treatment thereof, enhancing Anti-Tumor activities in the subject, or enhancing T cell response in the subject, the method comprising: administering an effective amount of modified cells of any preceding suitable embodiments to the subject, wherein the modified cells comprise the polynucleotide comprising an NFAT promoter, a nucleotide sequence encoding therapeutic agent, and/or a nucleotide sequence encoding a VHL-interaction domain of HIF1α, wherein the therapeutic agent comprises at least one of IL-12, the modified cells comprise a CAR or TCR binding CD19, CD20, CD205, and/or CD22.

EXAMPLES

Example 1: Modified Cells Expressing Cytokines and In Vitro Assay

FIGS. 6-14 show induced expression of cytokines on CAR T cells. The experiments were conducted to include various solid tumor markers (e.g., TSHR, ACPP, and GUCY2C). The data show that activated CAR T cells can induce the expression of IL-6, IL-12, and/or IFNγ, and the expression of various factors is significantly lower under aerobic conditions than under anaerobic conditions. It has also been shown that the regulated expression of cytokines can up-regulate factors related to the killing function of other cytokines (e.g., IFNγ and GZMB). Various vectors and cells are described in FIGS. 6-14 are listed in Table 2.

TABLE 2

| Name | Construction | Name | Construction | Name | Construction |
| --- | --- | --- | --- | --- | --- |
| 1604 | TSHR-BBz | 6503 | ACPP-BBZ | 6701 | GUCY2C-bbz |
| 6918 | TSHR-28z | 6521 | ACPP-bbz-NFAT6x-IL6 | 6923 | GUCY2C-28z |
| 6270 | TSHR-bbz-NFAT6x-IL12-VHL | 6523 | ACPP-bbz-NFAT6x-IFNg-2a-IL6 | 6278 | GUCY2C-bbz-NFAT6X-IL12-VHL |
| 6271 | TSHR-bbz-NFAT6x-IL12-VHL | 6524 | ACPP-bbz-NFAT6x-IFNg-2a-IL6VHL | 6279 | GUCY2C-28z-NFAT6X-IL12-VHL |
| 6526 | ACPP-bbz-NFAT6x-IL6-2a-IL12VHL | 6525 | ACPP-bbz-NFAT6x-IL6-2a-IL12 | | |

Note:
BBZ: 4-1BB and CD3 zeta;
28Z: CD28 and CD3 zeta

Figure 6:
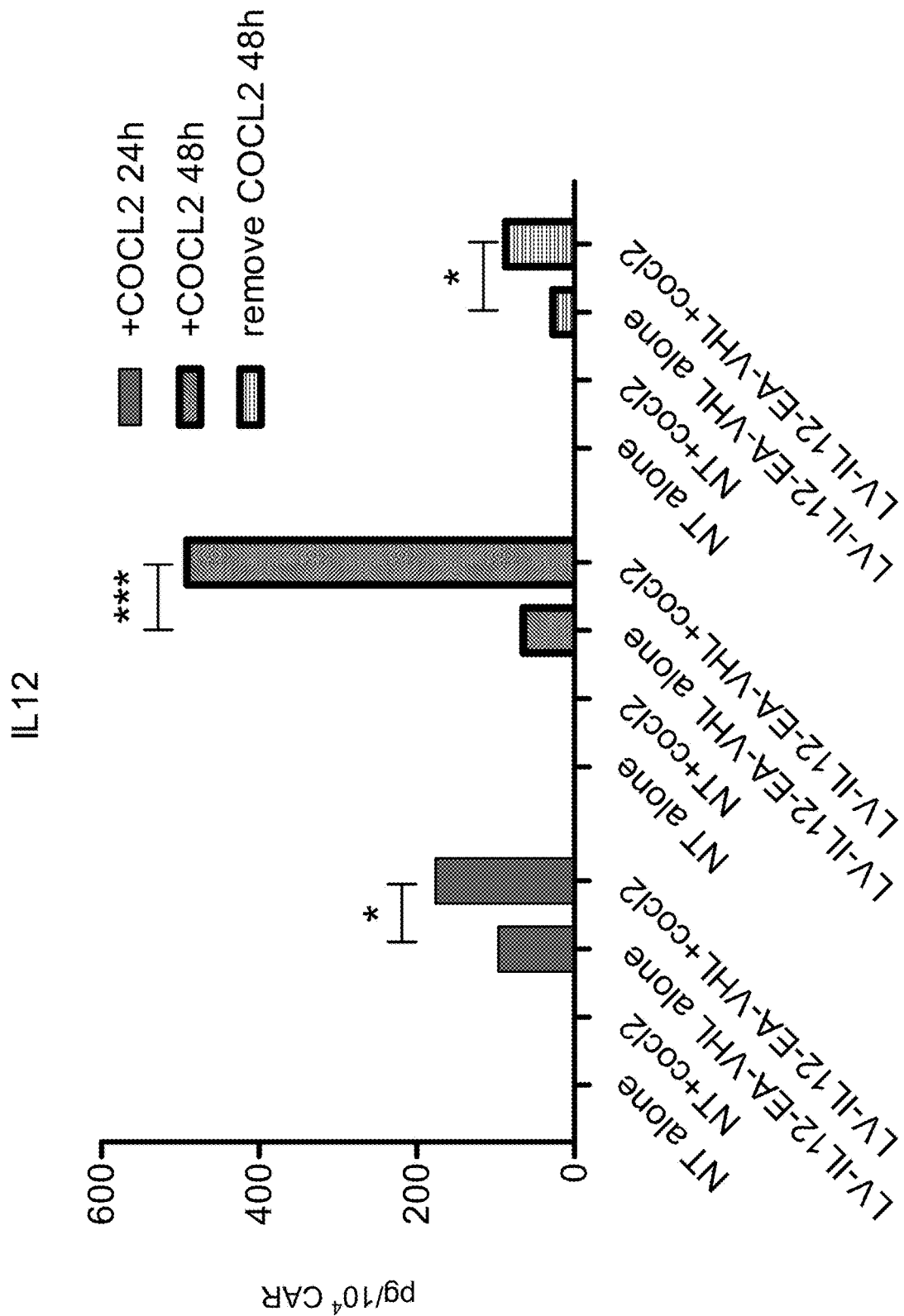
FIG. 6 shows the results of the anaerobic assay on various CAR T cells.
Figure 7:
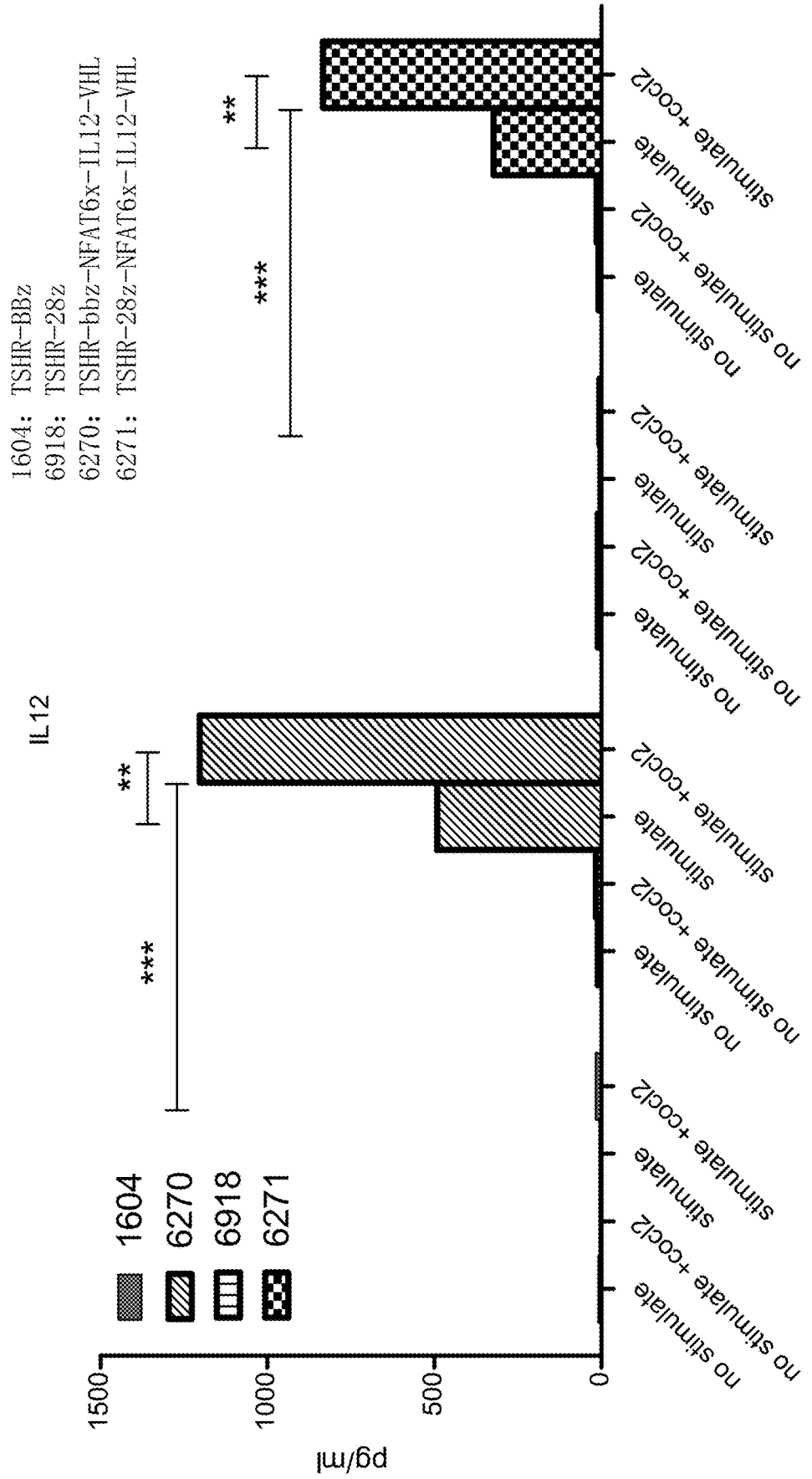
FIG. 7 shows cytokines released in response to hypoxia in TSHR-CAR T system.
Figure 8:
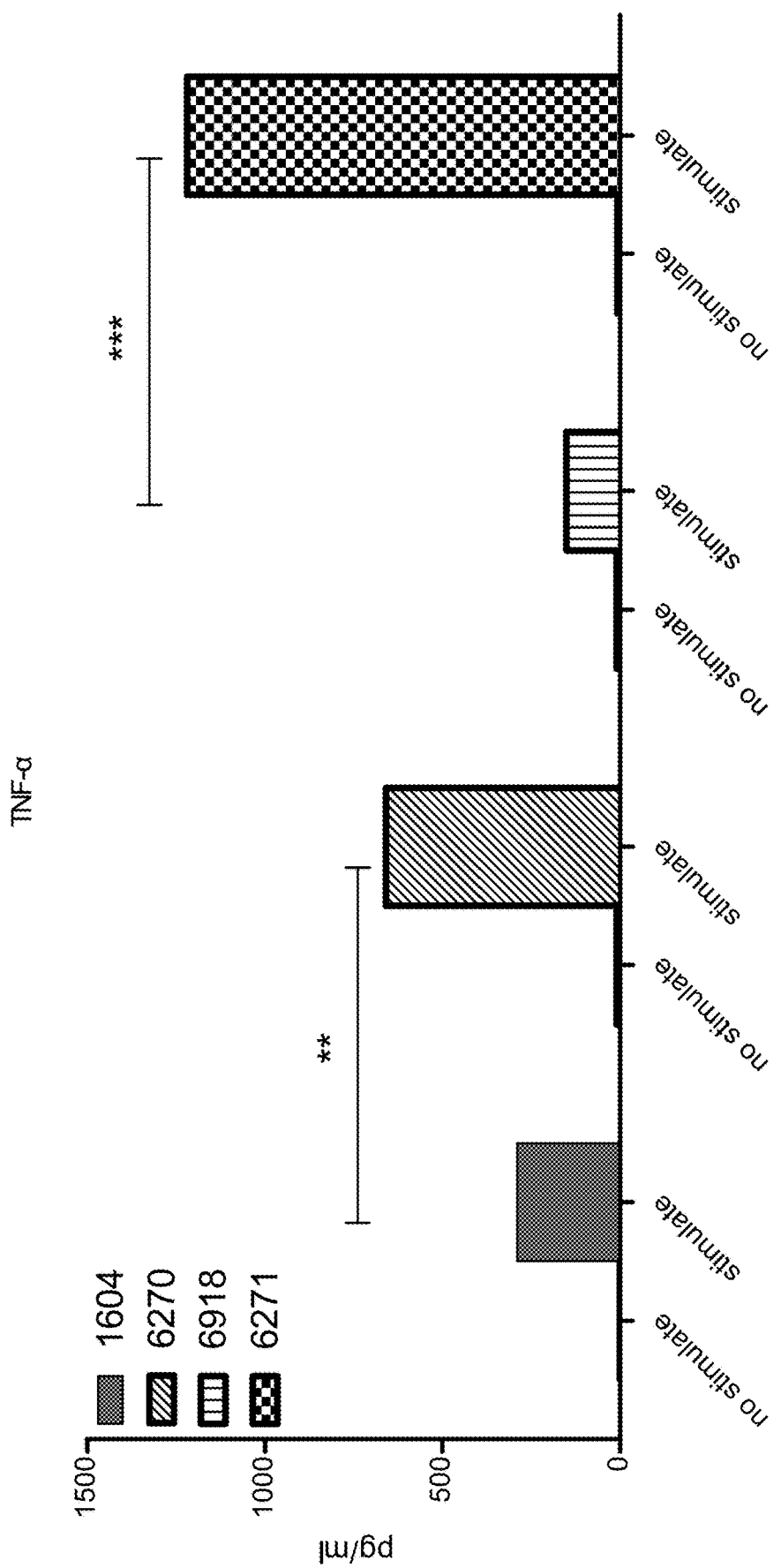
FIG. 8 shows TNFα released in response to the induction of IL-12 expression in CAR T cells.
Figure 9:
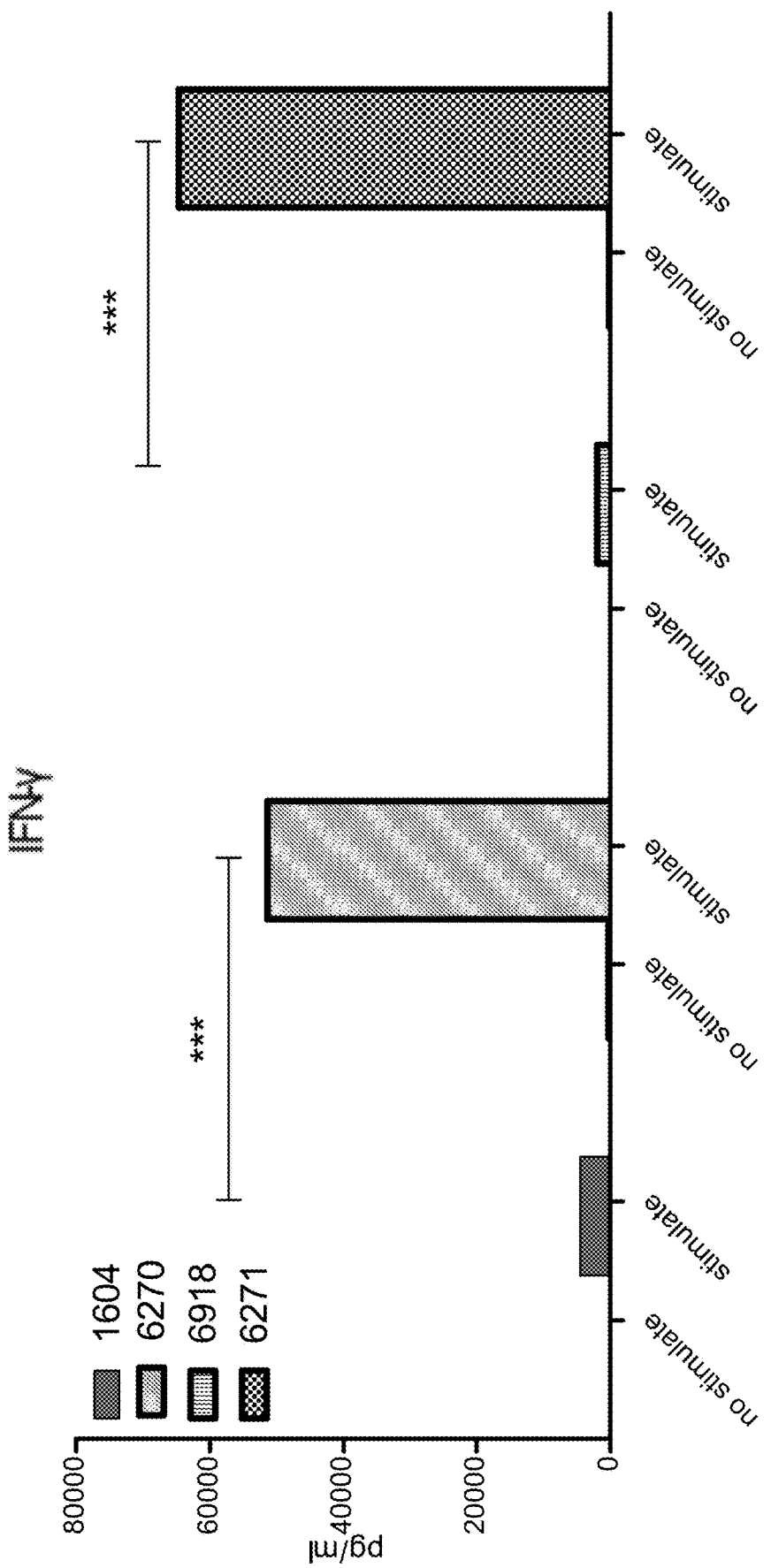
FIG. 9 shows IFNγ released in response to the induction of IL-12 expression in CAR T cells.
Figure 10:
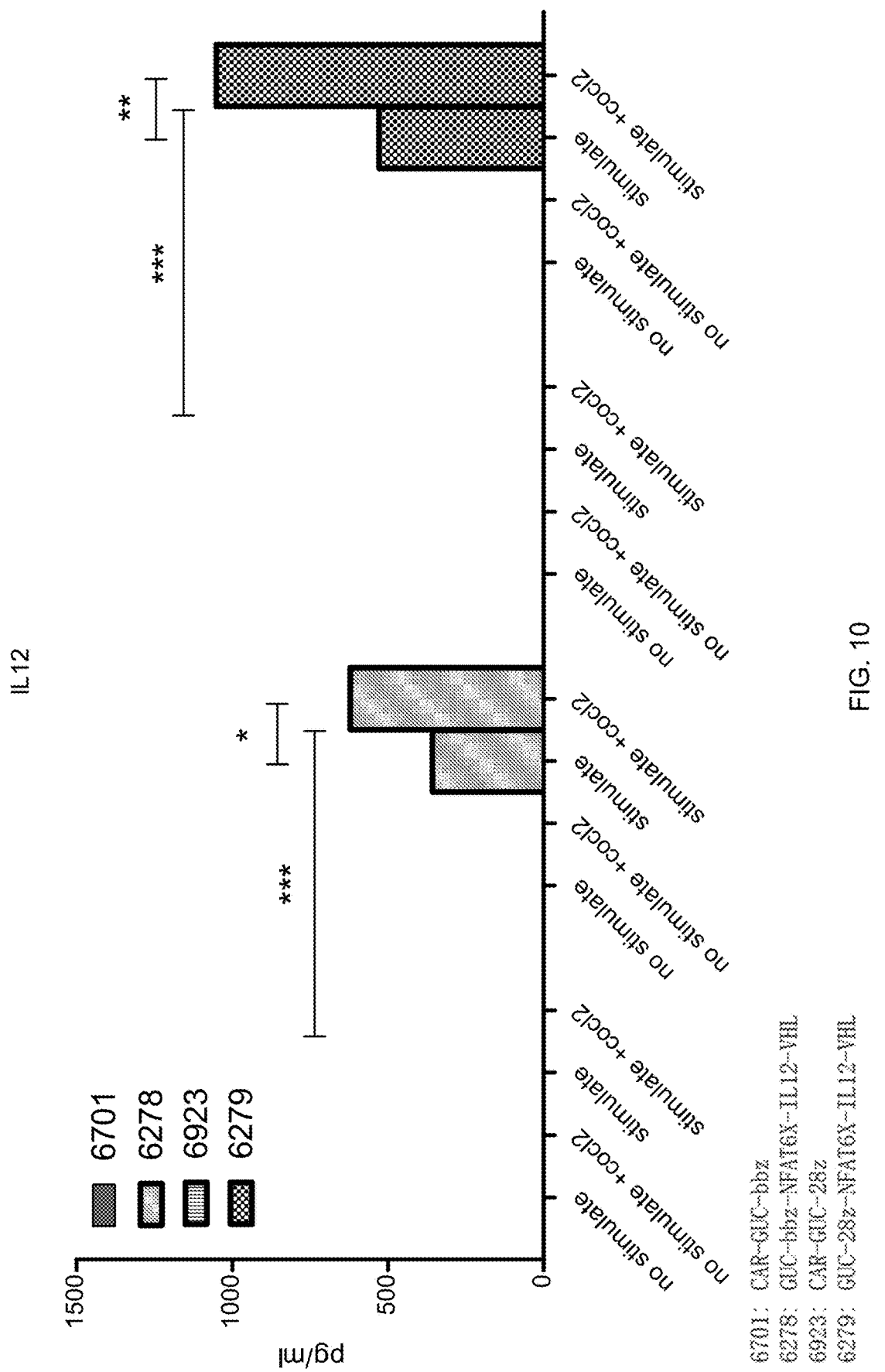
FIG. 10 shows IL12 released in response to hypoxia in GUCY2C-CART system.
Figure 11:
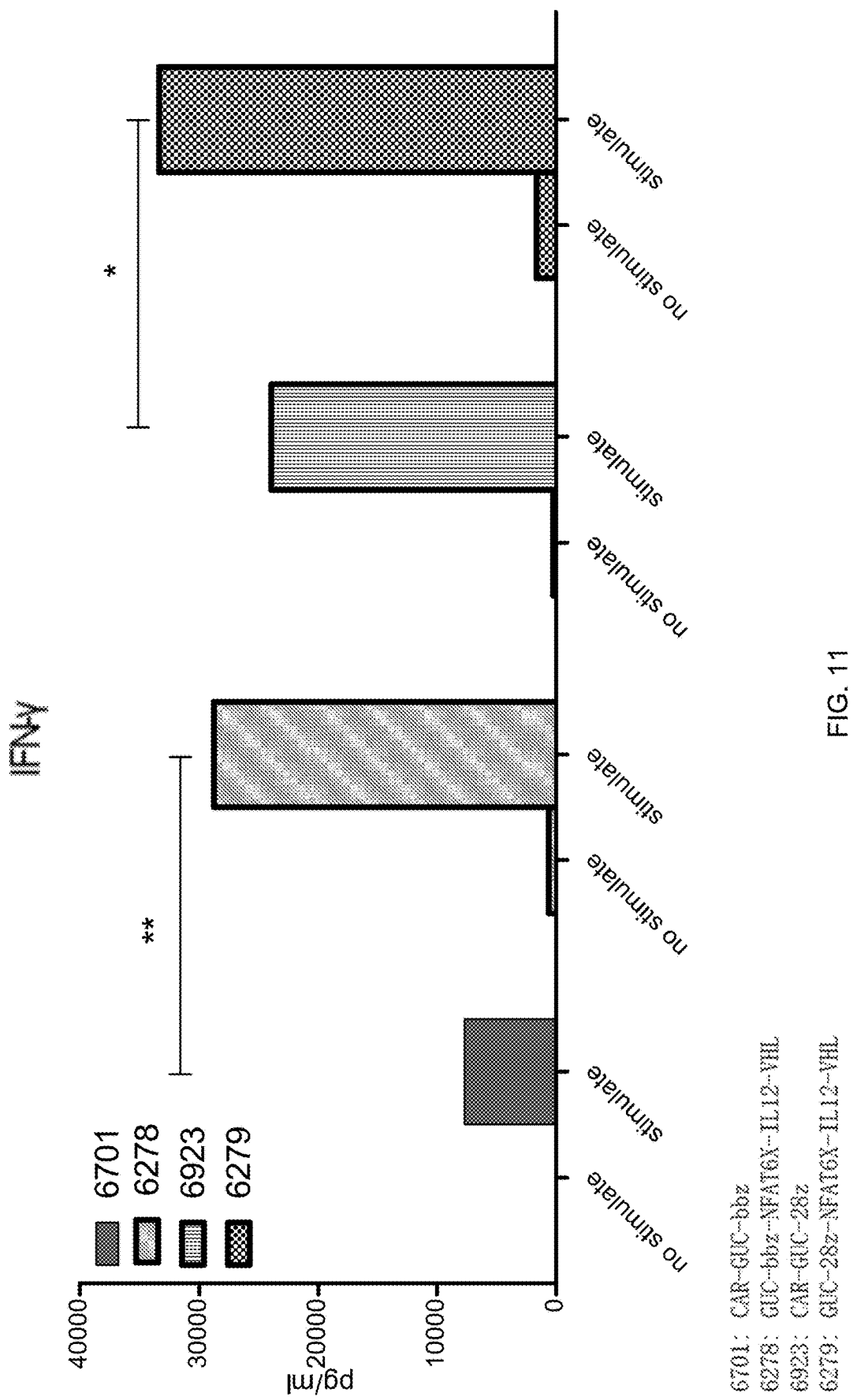
FIG. 11 shows IFNγ release in response to hypoxia in the GUCY2C-CAR T system.
Figure 12:
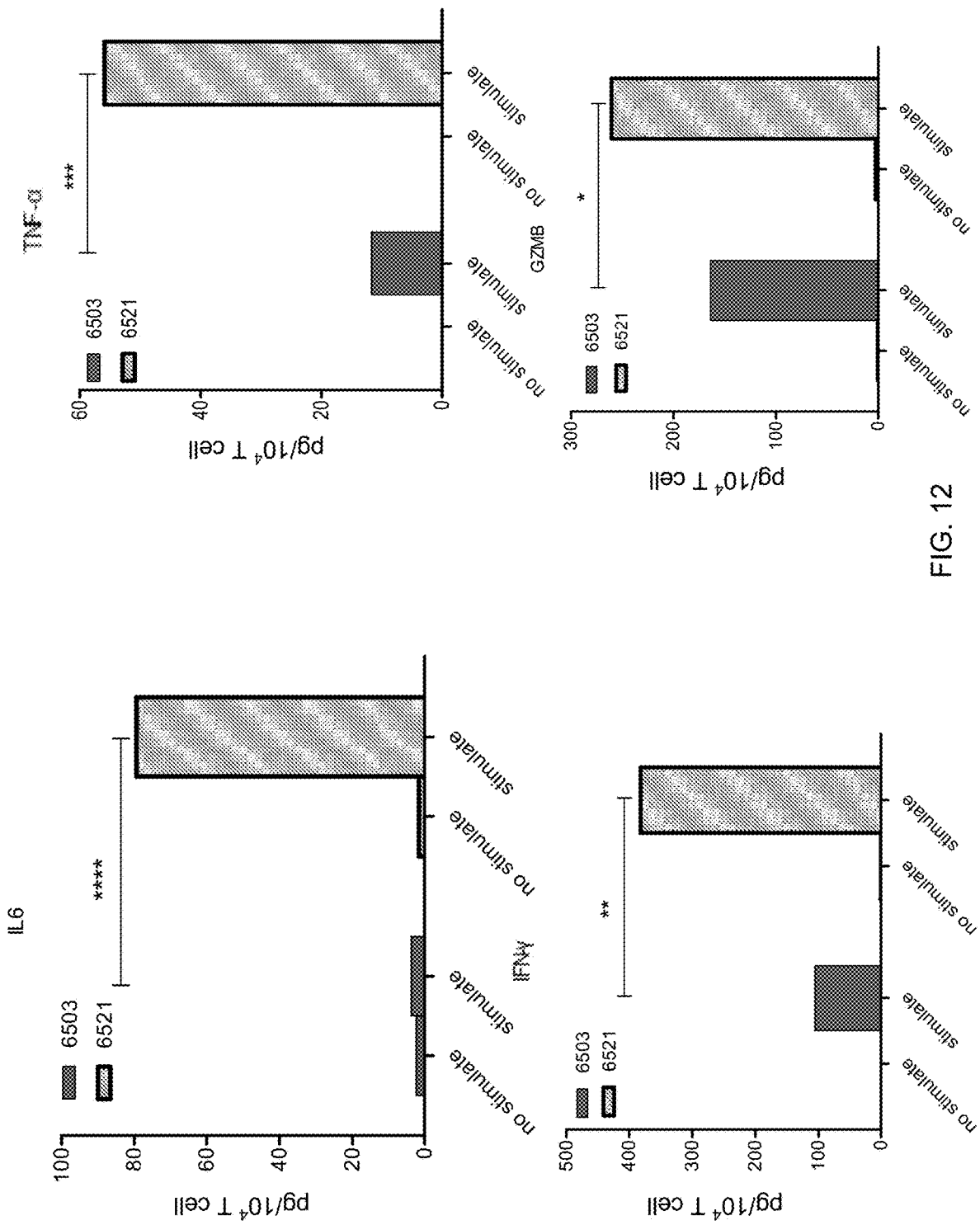
FIG. 12 shows cytokines released in ACPP-CAR T system.
Figure 13:
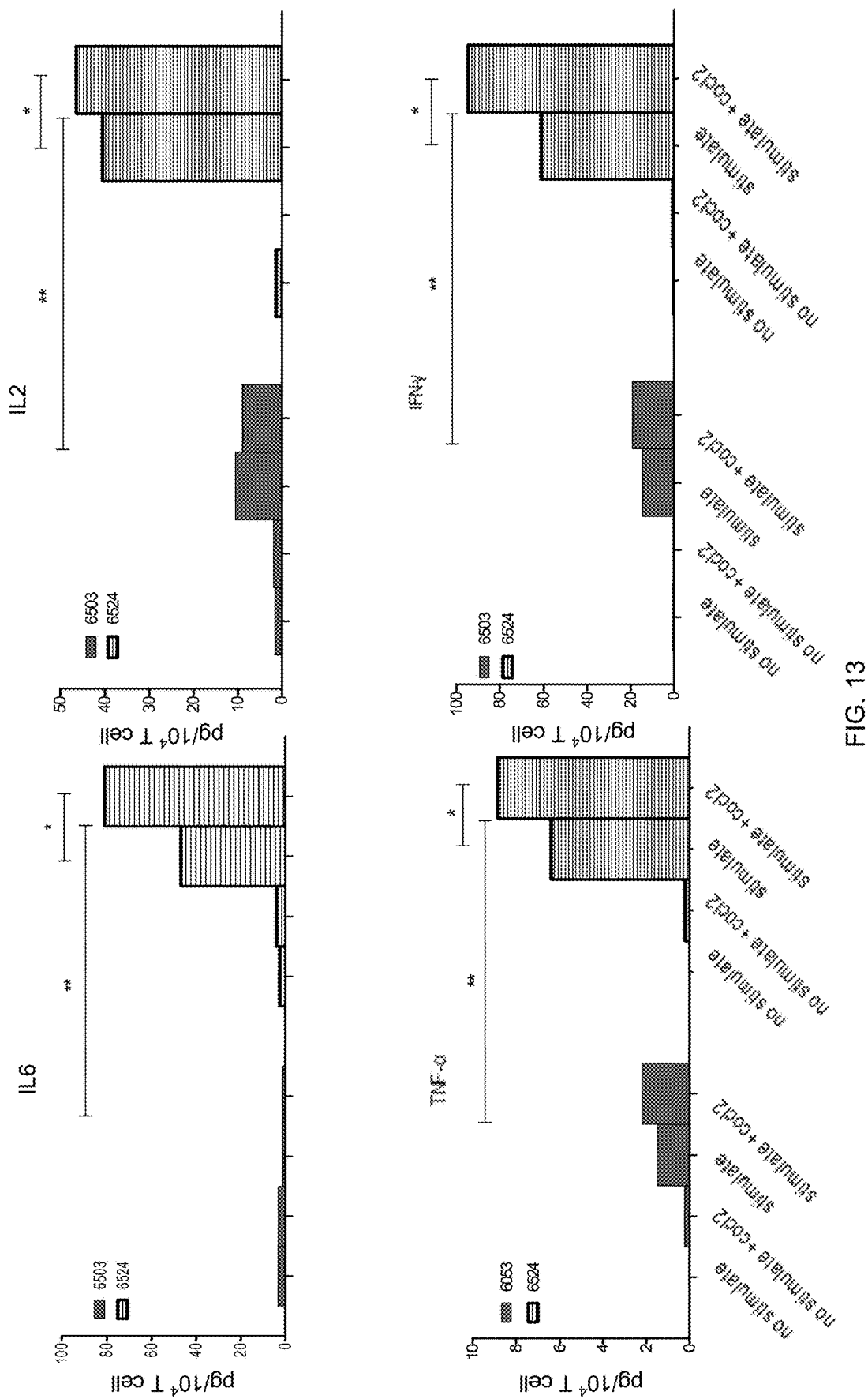
FIG. 13 shows cytokines released by modified cells in response to hypoxia in the ACPP-CAR T system.
Figure 14:
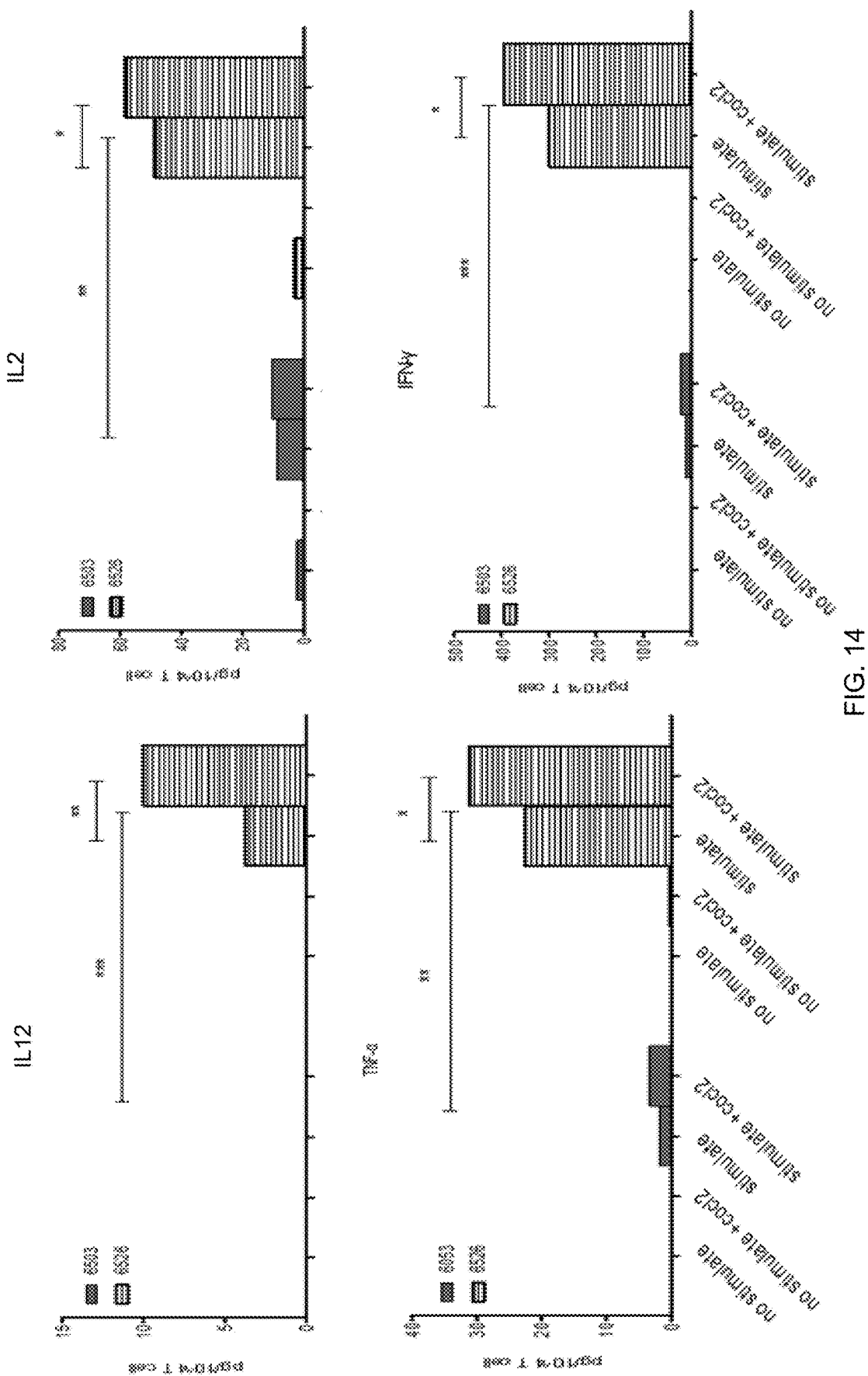
FIG. 14 shows cytokines released by modified cells in response to hypoxia in the ACPP-CAR T system.

FIG. 6 shows the results of an anaerobic assay. Protocols for preparing the CAR T cells and for cell culturing are similar to those in vitro assays described in PCT Publications WO2020106843 and WO2020146743, which are herein incorporated by reference in their entirety. In the anaerobic system simulated by $CoCl_2$, it can be seen from FIG. 6 that the release of IL-12 is regulated by oxygen. With the prolongation of $CoCl_2$, the release of IL-12 gradually increases, and IL-12 decreases significantly after 48 hours of withdrawal of $CoCl_2$. FIG. 7 shows cytokine releases in response to hypoxia in the TSHR-CART system. As shown, IL-12 was only expressed when 6270 and 6271 were activated and was regulated by the anaerobic switch VHL, and the release of IL12 was significantly increased under anaerobic conditions. FIGS. 8 and 9 show cytokine release in response to induction of IL-12 expression in CAR T cells. The expression of IL12 effectively up-regulated the expression of IFNγ and TNF-α, indicating that the system can further increase the release of IFNγ/TNF-α and enhance the function of CAR T cells by regulating the expression of IL-12. FIG. 10 shows cytokine release in response to hypoxia in the GUCY2C-CAR T system. FIG. 11 shows IFNγ release in response to induction of IL-12 expression in CAR T cells. FIG. 12 shows IL-6 is induced by T cell activation, and T cell inactivation does not express IL-6; and induction of IL-6 expression can up-regulate the release of T cell killing function-related factors such as TNF-α, IFNγ, and GZMB. FIGS. 13 and 14 show cytokine release in response to hypoxia in the ACPP-CAR T system. Further data show that the expression of IL-6, IFNγ, and/or IL-12 effectively up-regulated the expression of other inflammatory factors such as GZMB and TNF-α, thereby enhancing the function of CAR T cells.

Example 2: CAR T Cell Expansion and Anti-tumor Activity in Patients

Clinical studies were designed to assess the safety and efficacy of infusing autologous T cells modified to express several solid tumor markers specific CAR/4-1BB/CD3-3 into patients. On the first arm of the studies, patients received solid tumor marker-specific CAR T cells only. The solid tumor marker included ACPP T cells of the patients were obtained, modified, and infused to patients. T cell responses of patients from the first and second arms were measured and compared using the following protocols, which were approved by the hospitals where the trials were conducted. All patients were provided with written informed consent. Information regarding these patients is provided below in Tables 3 and 4 (SD: stable disease; PD: progressive disease; PR: partial remission; CR: complete remission; NR: no response).

PBMCs were obtained from patients. Various lentiviral vectors were generated and then transfected to the T cells, which were further cultured for several days before the co-cultivation assay. More information can be found in Tables 3 and 4 below. Techniques related to cell cultures, construction of cytotoxic T-lymphocyte assay can be found in "Control of large, established tumor xenografts with genetically retargeted human T cells containing CD28 and CD137 domains," PNAS, Mar. 3, 2009, vol. 106 no. 9, 3360-3365, which is incorporated herein by reference in its entirety. PBMCs were cultured using TEXMACS culture media containing IL-2. CD4 and CD8 magnetic beads were used to sort and select T cells in the PBMCs. The appropriate starting culture amount was selected, and Transact activator was used to activate T cells. MACS® GMP T Cell Trans-Act™ includes a colloidal polymeric nanomatrix covalently attached to humanized recombinant agonists against human CD3 and CD28. Due to the nanomatrix MACS GMP T Cell TransAct can be sterile filtered, and excess reagent can be removed by centrifugation and following conventional supernatant replacement or simply by media wash. This reagent is suitable for use in automated culture systems, such as the CliniMACS Prodigy® Instrument. The number of corresponding carriers and the volume of the carrier were calculated according to the required carrier MOI. Information of MOI and clinical trials may be found at PCT Publication Nos: WO2020106843 and WO2020146743, which are incorporated by reference of their entireties.

For fresh cells, after removing the magnetic beads, the transduced cells were centrifuged or replaced with a solution of 95% compound electrolyte and 5% human albumin, loaded into a return bag, and transported at 15-25° C. after sealing. Fresh preparations are returned directly. For cryopreserved cells, the media including 33.75% compound electrolyte solution, 33.75% dextran 40 glucose solution, 25% human blood albumin, and 7.5% dimethyl sulfoxide was used for cryopreservation. The cell suspension was loaded into a cryopreservation bag, and then the bag was cooled to −90° C. and transferred to a gas phase liquid nitrogen tank for storage. The reconstitution of the frozen preparations was completed within 30 minutes after resuscitation of the frozen preparations. Peripheral blood mononuclear cells (PBMCs) were obtained from patients by leukapheresis for CAR T cell preparation, and the first day of CAR T infusion was set as study Day 0.

Patients were given a conditioning treatment for lymphodepletion for CAR T cell infusion. Fludarabine- and cyclophosphamide-based conditioning treatment varied according to the tumor burden in the bone marrow (BM) and peripheral blood (PB). Some patients were administered a long-acting G-CSF for 1-3 days after the conditioning treatment at a dose of about 6 mg each or 100 μg/kg of body weight to boost the patient's neutrophils, which are critical to fighting off infections. CAR T cells were transfused to the patients. Each day CAR T cells were transported to the hospital, washed, counted, checked for viability, and then prepared for administration to patients, who were then observed closely for at least 2 hours. Cytokine Release Syndrome (CRS) was graded according to a revised grading system (See Lee D W. et al., Blood 2014; 124:188-95). Other toxicities during and after therapy were assessed according to the National Institutes of Health Common Terminology Criteria for Adverse Events Version 4.0 (http://ctep.cancer.gov/). Therapy responses were assessed by flow cytometry and morphological analysis. When possible, patients were assessed by chimeric gene expression levels.

Bone Marrow (BM) and peripheral blood (PB) samples after CAR T cell infusion were collected in K2EDTA BD vacutainer tubes. The persistence of CD19 CAR T cells in PB and BM of patients was determined by FACS. Circulating CAR T cell numbers per μl were calculated on the basis of measured absolute CD3+ T lymphocyte counts. Simultaneously, CAR DNA copies were evaluated as another method of determining CAR T cell expansion and persistence. Genomic DNA was extracted using a QIAamp DNA Blood Mini Kit (Qiagen) from cryopreserved PB and BM. CAR DNA copies were assessed by quantitative real-time PCR as described in the supplementary materials. The levels of cytokines, for example, IFN-γ, TNF-α, IL-4, IL-6, IL-10, IL-17, in peripheral blood and CSF, were measured in a multiplex format according to the manufacturer's instructions.

Genomic DNA was extracted using a QIAamp DNA Blood Mini Kit (Qiagen) from cryopreserved peripheral blood and bone marrow. Quantitative PCR (qPCR) was performed in real-time in triplicates using the ABI 2×TaqMan Universal Master Mix with AmpErase UNG (Applied Biosystems) in a 7500 real-time PCR system (Applied Biosystems). Copy numbers per microgram of genomic DNA were calculated from a standard curve of 10-fold serial dilutions of purified CAR plasmid containing 102-108 copies/μL. Amplification of an internal control gene was used for the normalization of DNA quantities. Primers/probes specific for the CAR transgene and an internal control gene were as previously described (see Gökbuget N. et al., Blood 2012; 120:2032-41 and O'Brien S. et al., J Clin Oncol 2013; 31:676-83).

The patient 01 was diagnosed with recurrent prostate cancer. PBMCs of the patient was obtained, and T cells were selected from the PBMCs. These T cells were transferred with mixed of vectors in Table 4 to generate mixed cells. Before the mixed cells were transported to the hospital, and the quality control process was performed. Appearance, cell counting, t cell purity, identity, potency (cart percentage), potency (cytokine), potency (transduction efficiency), dose, vsv-g copy, endotoxin, sterility, and *Mycoplasma* (qPCR) of these T cells were measured. For example, the ratio of CD19 CAR cells and ACPP CAR cells was measured to be about 1:4. T cell response assay was also performed. The mixed cells were cultured with CD19 positive cells and/or ACPP positive cells, and T cell response (e.g., cytokine release) was measured.

Figure 22:
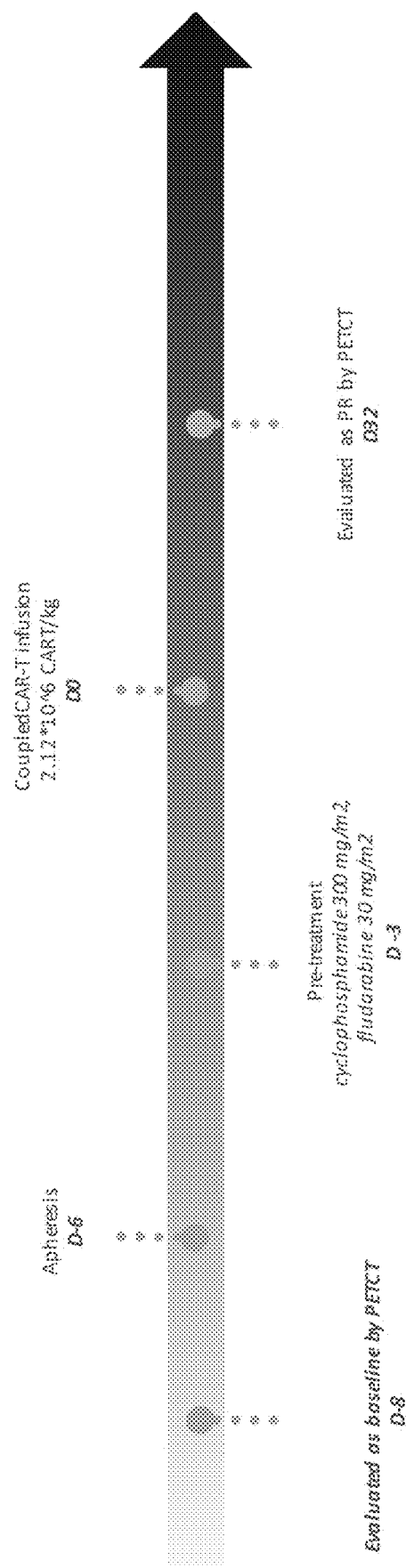
FIG. 22 shows a protocol of a clinical trial of treating cancer patients using ACPP CAR T cells.
Figure 23:
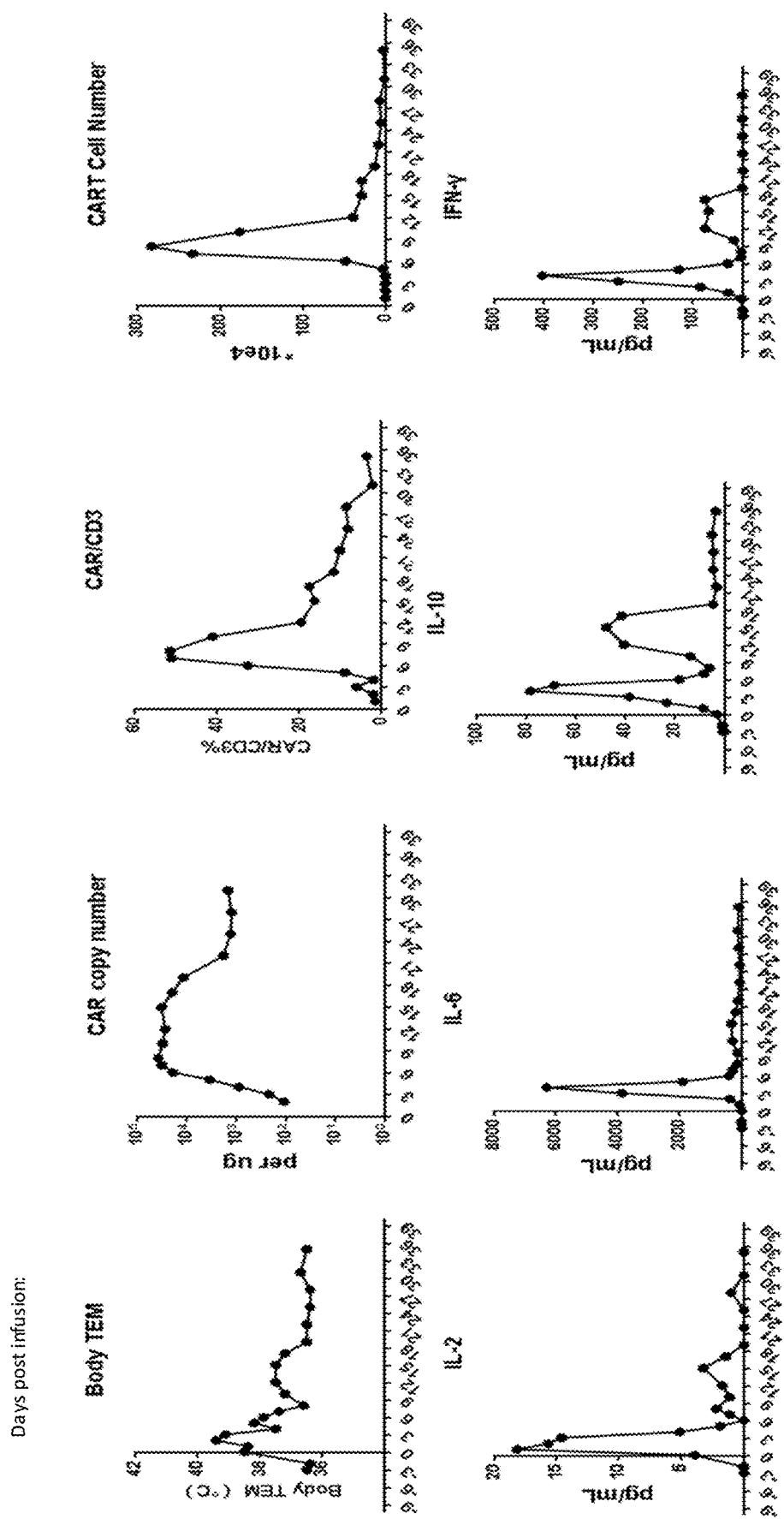
FIG. 23 shows cytokines released by ACPP CAR T cells in the body of a patient.
Figure 24:
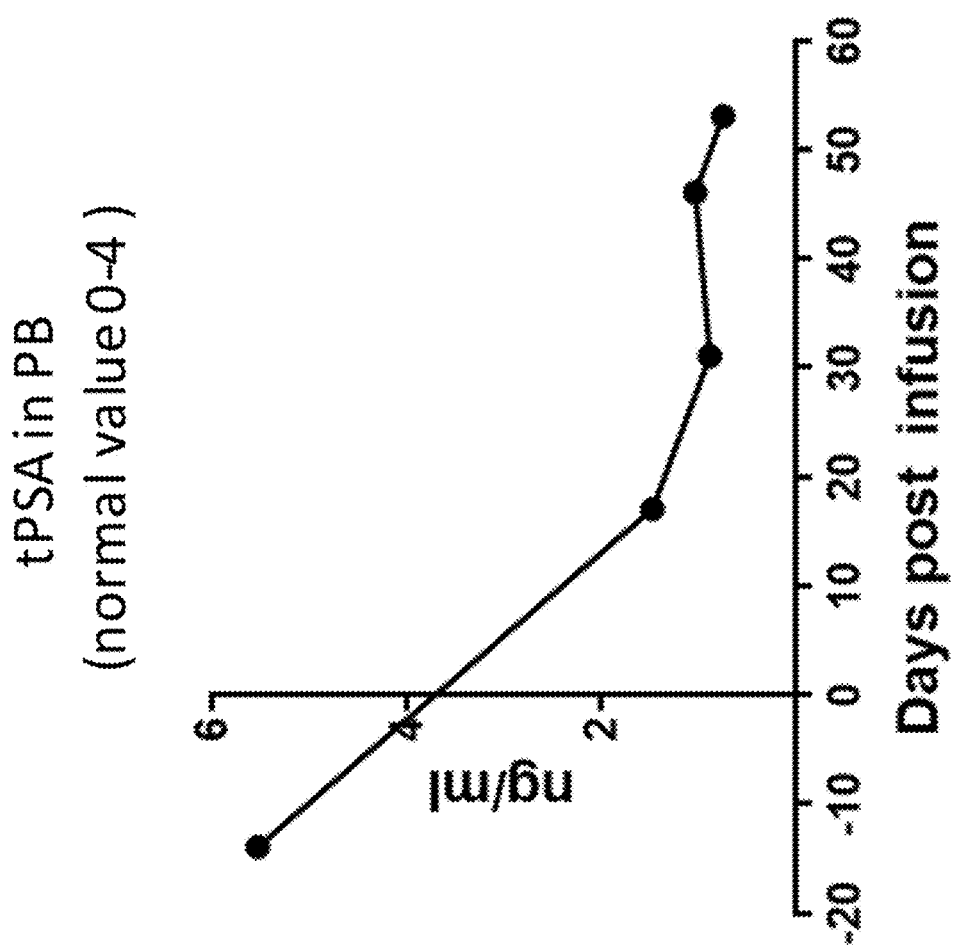
FIG. 24 shows a total prostate specific antigen (PSA) assay in the peripheral blood (PB) of a patient.
Figure 25:
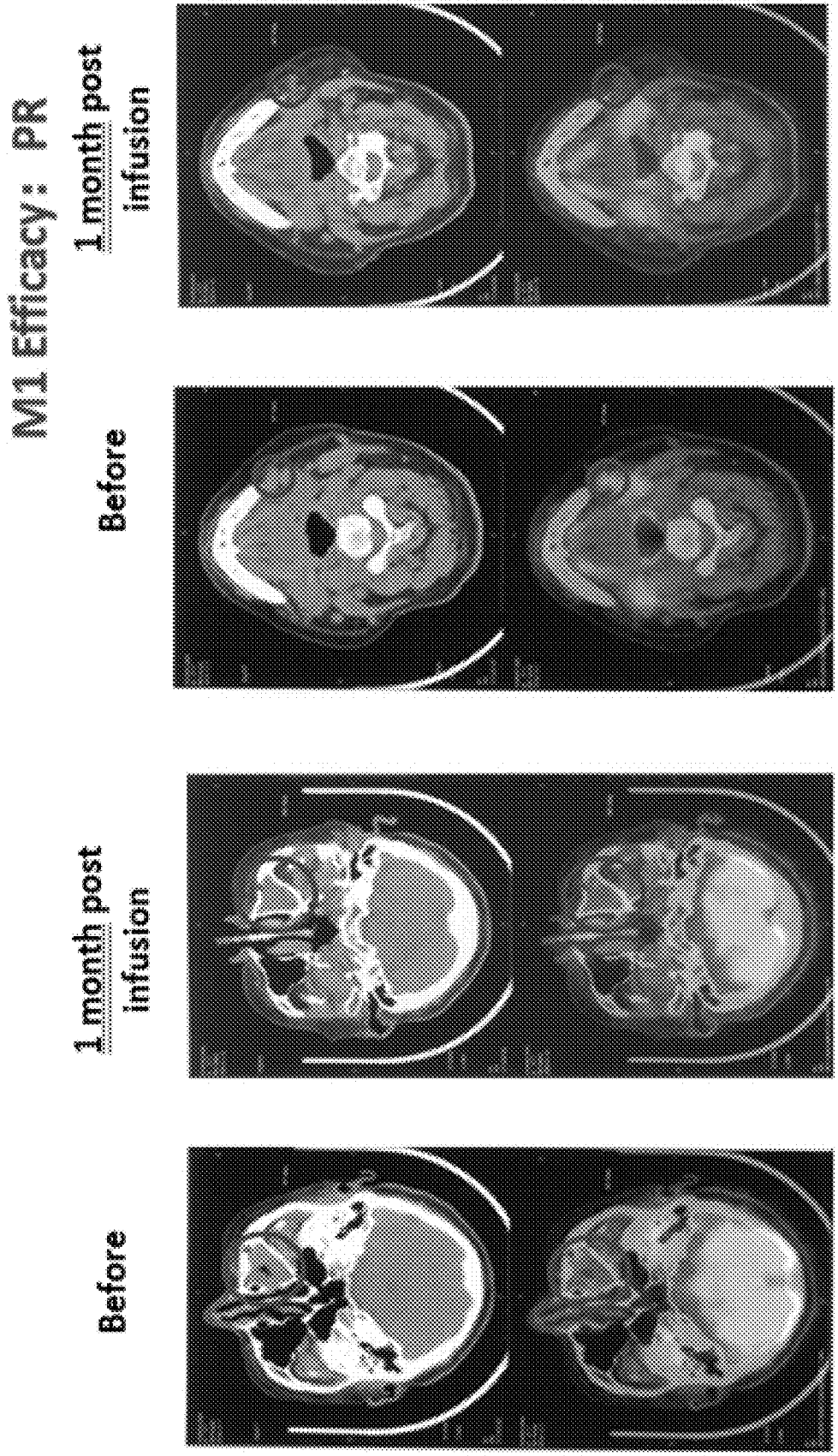
FIG. 25 shows PET-CT scanning images of a patient one month after infusion of CAR T cells.
Figure 26:
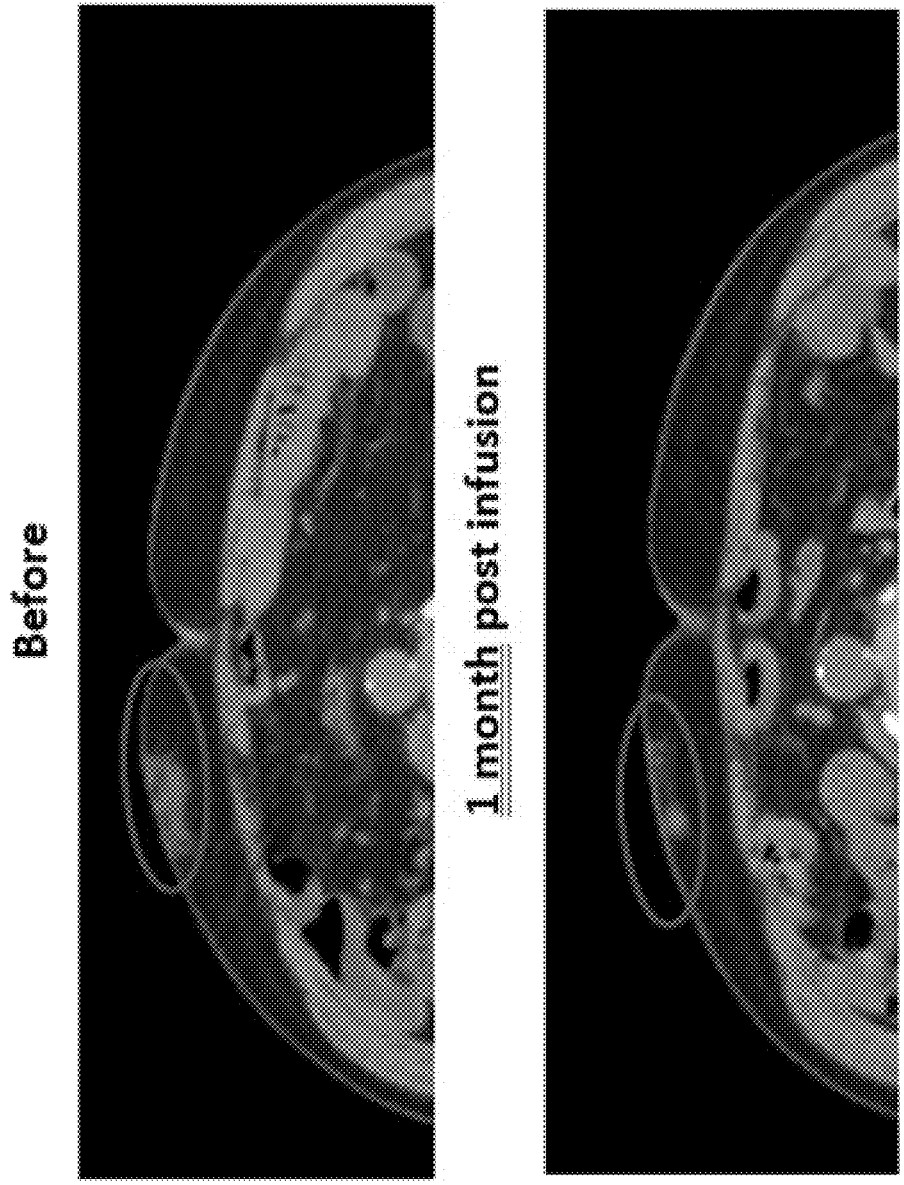
FIG. 26 shows additional PET-CT scanning images of the patient.
Figure 27:
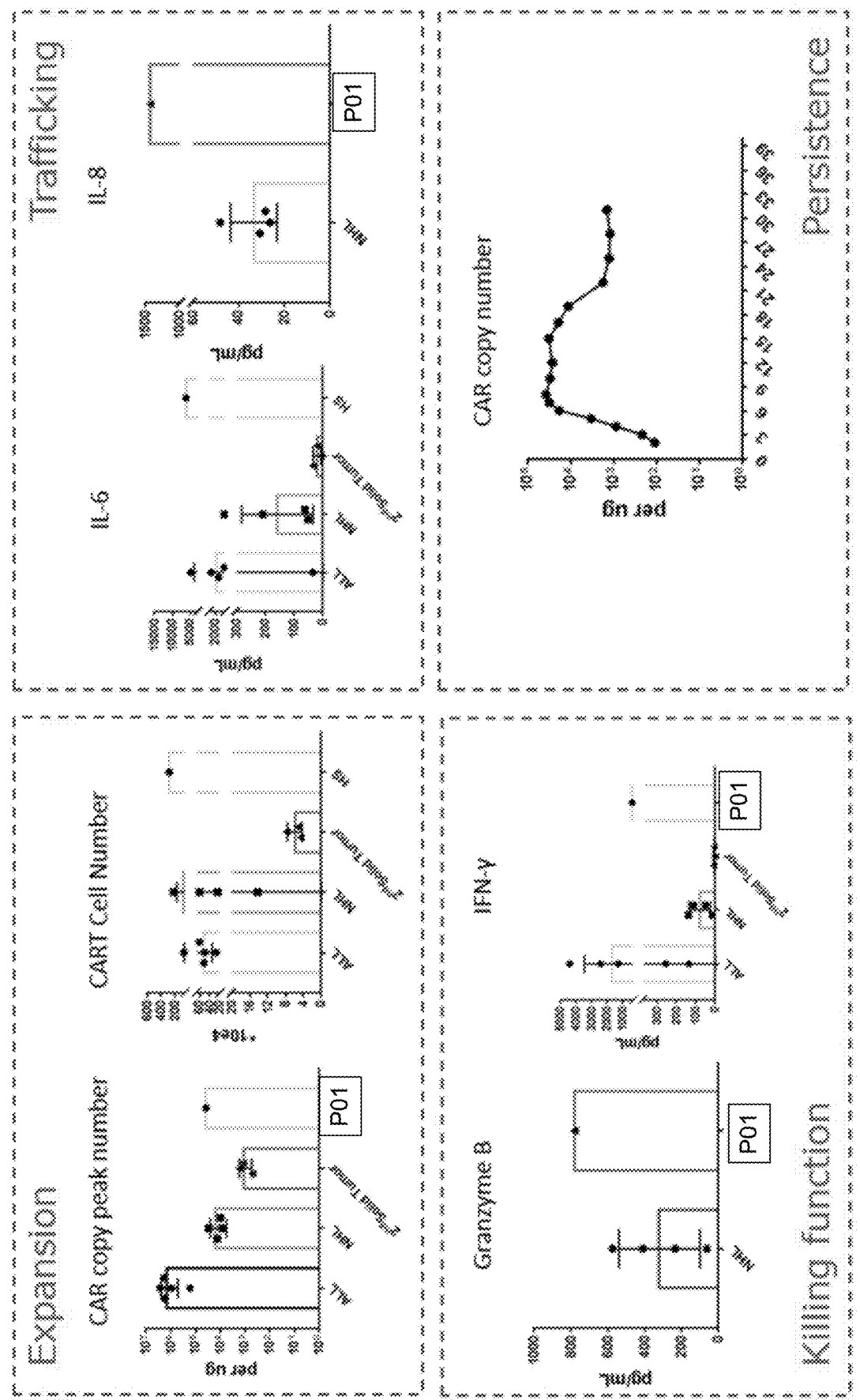
FIG. 27 shows comparisons of treatment of Patient 01 (P01) and other treatments using the $2^{nd}$ generation of CAR T technology in treating blood tumors.

FIG. 22 shows the protocol for the treatment using ACPP CAR T cells. FIG. 23 shows cytokine release in response to the infusion of cells including ACPP CAR T cells. As shown in FIG. 23, cells including vectors encoding IFNγ appeared to be enriched. FIG. 24 shows tPSA assay in the peripheral blood of the patient. FIGS. 25 and 26 show PET-CT scanning images of the patient one month after the cell infusion. FIG. 27 shows the comparisons between this clinical trial and other trials using the $2^{nd}$ generation of CAR T technology and/or treating blood tumors.

TABLE 3

Clinical trial data

| Patient's ID | Cancer | Infusion CART/kg | CSR > 2 | Efficacy |
|---|---|---|---|---|
| 01 | r/r prostate adenocarcinoma | $2.12 \times 10^6$ | No | PR |

TABLE 4

Preparation of cells for clinical trials

| Patient's ID | Vectors | Infusion Methods | Pre-treatment |
|---|---|---|---|
| 01 | Vector 1: ACPP-CAR (CAR: SEQ ID No: 515, scFv of the CAR: SEQ ID NO: 471); Vector 3: hCD19-CAR-NATF-IL12-VHL (Vector SEQ ID NO: 485, scFv of CD19 CAR: SEQ ID 5, 6xNFAT: SEQ ID: 481, aa of IL12: SEQ ID NO: 486, VHL: SEQ ID NO: 487; and Vector 4: hCD19-CAR-NATF-IFNγ (Vector SEQ ID NO: 480, scFv of CD19 CAR: SEQ ID 5, 6xNFAT: SEQ ID: 481, and aa of IFN-γ: SEQ ID NO: 484; and Vector 5: hCD19-CAR-NATF-IL6 (Vector SEQ ID NO: 480, scFv of CD19 CAR: SEQ ID 5, 6xNFAT: SEQ ID: 481, and aa of IL6: SEQ ID NO: 482; | Fresh cells | FC regimen at −2 days (cyclophosphamide 500 mg/m2, fludarabine 30 mg/m2) |

Example 3: UPK2 Antibody Preparation and Anti-ACPP CAR

The recombinant UPK2 extracellular domain (UPK2-His) was prepared using an *E. coli* expression system. BALB/c mice of 6-8 weeks old were taken, and the mice were subjected to tail vein blood sampling to leave the background serum before immunization. The UPK2-His recombinant antigen was provided to mice for the first time and emulsified with complete Freund's adjuvant. Each mouse was intraperitoneally injected with 50 μg of recombinant antigen. After the initial immunization, a booster dose of recombinant UPK2-His antigen emulsified with incomplete adjuvant was administered two weeks later. Each mouse was intraperitoneally injected with 50 μg of recombinant antigen for three booster immunizations. The tail vein blood collection was performed before the third booster immunization to analyze the serum UPK2 antibody titer. The results showed that the antibody titer of UPK2 in the serum of three of the four mice reached 106 or more, indicating that the immunization was successful.

The fifth immunization was changed to shock the immunization, and the UPK2-His recombinant antigen without adjuvant was used as the immunogen. Each mouse was intraperitoneally injected with 50 μg of recombinant antigen, and the mice were sacrificed 3 days after the immunization. Spleen cells were collected from mice and labeled as "left front" in the graph.

The mouse spleen lymphocytes were separated using mouse lymphocyte separation solution (Dakko, CAT #DKW33-R0100), and the isolated lymphocytes were totaled using the total RNA extraction kit (Tiangen, CAT #DP430). RNA extraction. Using the extracted total RNA as a template, the first-strand cDNA synthesis kit (Thermo scientific, CAT #K1621) was used to synthesize the heavy chain variable region and the light chain variable region, respectively. The reverse transcription primers were gene-specific primers, and the primer pairing was performed. The regions are located in the heavy antibody chain constant region and the antibody light chain constant region, respectively. The synthesized cDNA was immediately stored at −70° C. for storage. Then, the cDNA was obtained by reverse transcription and used as a template to obtain the primers (Journal of Immunological Methods, 201 (1997), 35-55), and the murine antibodies VH and VK were amplified by PCR, respectively. The overlap extension PCR technique was used to construct a single-chain antibody (scFv). Finally, the prepared mouse single-chain antibody gene was cloned into the vector pADSCFV-S to construct an ScFv library. The library capacity of this antibody library reached $1.6 \times 10^8$, and the correct rate was 41.5%.

Using recombinant UPK2-his as the antigen, the mouse single-chain antibody library was screened by reference to the classical solid-phase screening strategy, and three rounds of screening were performed by means of binding, elution, neutralization, infection, and amplification in the second round. After the third round of screening, about 700 monoclonal clones were identified by phage ELISA. Sixty clones with high positive ELISA signal were selected for sequence analysis to obtain eight strains with different sequences that bind to UPK2-His. The eight antibodies are: clone S2B7, S2E2, S3A4, S3C10, S3D10, S7F9, S7F11 and S7G7. The heavy and light chain variable region sequences (scFv) of the eight monoclonal antibodies are shown in Table 5.

The heavy and light chain variable region genes of the above eight scFvs were cloned into the eukaryotic expression vectors pTSEG1n and pTSEK, respectively, and eight murine-human chimeric antibodies (murine antibody variable regions) were prepared using the company's HEK293 cell transient expression system. Human antibody constant region). The whole recombinant antibody was purified by Protein A affinity chromatography column, and SDS-PAGE showed. These eight antibodies were normally expressed, and their purity met the level for protein identification.

The ability of whole recombinant antibodies to bind antigen UPK2-His was analyzed using a classical ELISA method. All 8 antibodies can bind to the antigen UPK2-His. At the same time, the specificity of the prepared monoclonal antibody was analyzed by a similar ELISA method. The eight recombinant antibodies can specifically recognize the recombinant UPK2-His, and there are no obvious non-specific bindings of various unrelated antigens.

The affinity of the eight monoclonal antibodies was analyzed using GE's BIAcore X-100. Affinity analysis was performed using a conventional procedure by first capturing the human monoclonal antibody with an anti-human antibody coated on a chip and then using different concentrations of recombinant UPK2-His as the mobile phase for affinity analysis. As shown in Table 5, the affinity (KD) of these recombinant antibodies is mostly between 0.1 nM and 10 nM. Among them, the binding and dissociation of S7F11/S7G7 were slow, and the binding of S3D10 was too slow. When the three monoclonal antibodies were analyzed by BIAcore X-100 for affinity analysis, the automatic fitting of KD was poor, and the data was for reference only.

TABLE 5

Recombinant anti-UPK2 monoclonal antibody affinity parameters determined by BIAcore

| Monoclonal antibody | Kon | Koff | KD | Remarks |
|---|---|---|---|---|
| S2B7 | $1.493 \times 10^5$ | $3.495 \times 10^{-3}$ | $2.34 \times 10^8$ | |
| S3A4 | $1.125 \times 10^5$ | $3.05 \times 10^{-3}$ | $2.712 \times 10^{-8}$ | |
| S7F9 | $1.4 \times 10^5$ | $2.344 \times 10^{-3}$ | $1.674 \times 10^{-8}$ | |
| S2E2 | $1.381 \times 10^6$ | $3.894 \times 10^{-3}$ | $2.82 \times 10^{-9}$ | |
| S3C10 | $1.226 \times 10^6$ | $1.117 \times 10^{-3}$ | $9.109 \times 10^{-10}$ | |
| S7F11 | $3.504 \times 10^3$ | $8.126 \times 10^{-6}$ | $2.319 \times 10^{-9}$ | Kd overrun |
| S7G7 | $5.049 \times 10^4$ | $1.202 \times 10^{-6}$ | $2.381 \times 10^{-11}$ | Kd overrun |
| S3D10 | $6.431 \times 10^2$ | $2.614 \times 10^{-3}$ | $4.064 \times 10^{-6}$ | U-value = 15 |

In this study, the recombinant UPK2 extracellular domain (UPK2-His) was used to complete the immunization of mice, the construction, screening, and monoclonal identification of the murine immune library. Eight murine monoclonal antibodies (S2B7, S2E2, S3A4, S3C10, S3D10, S7F9, S7F11, and S7G7), with different sequences and capable of recombinant binding UPK2, were obtained. And preliminary specificity analysis showed that these monoclonal antibodies specifically bind to recombinant UPK2-his. Affinity analysis based on BIAcore showed that the affinity of these recombinant anti-UPK2 antibodies was mostly between 0.1 nM and 10 nM.

293T cells were transiently transfected with 6600 (Lenti-UPK2 antigen plasmid). 106 cells were mixed with 2 μg plasmids. Eight UPK2 antibodies were used to flow-stain 293T cells after transfection with 6600 plasmids. Goat-anti-human FITC was used as the secondary antibody. S2E2, S3C10, and S3A4 antibodies showed signals. Repeat the experiment was performed using a concentration gradient. 293T cells were transiently transfected with 6600 (Lenti-UPK2 antigen plasmid). 1 ug, 0.3 ug, and 0.1 μg of 8 antibodies were used to flow-stain 293T cells after transfection with 6600 plasmids. Goat-anti-human FITC was used as the secondary antibody. S2E2, S3C10, S3A4 antibodies showed signals.

Peripheral blood of healthy volunteers was taken on Day 0, and CD3+ T cells were sorted with pan T Kit; T cells were stimulated by CD3/CD28 Dynabeads at a ratio of 1:1. 106 T cells were infected by lentivirus encoding S2E2 UPK2 CAR (MIO=30) and lentivirus encoding S3C10 UPK2 CAR (MOI=38.7) on Day 1, respectively. 106 T cells were used as NT. The medium was changed on Day 2, the lentivirus and dynabeads were removed, and the T cells were resuspended in a fresh medium. CAR ratio and cell phenotype were detected by flow cytometry on Day 6. UPK2 CAR is a murine antibody, and it is detected by a murine CAR antibody. mCAR expression of S2E2 UPK2 CAR has 87.14% of, and S3C10 UPK2 CAR has 80.6%. mCAR expression was adjusted according to 80.6% expression in the following results.

Figure 15:
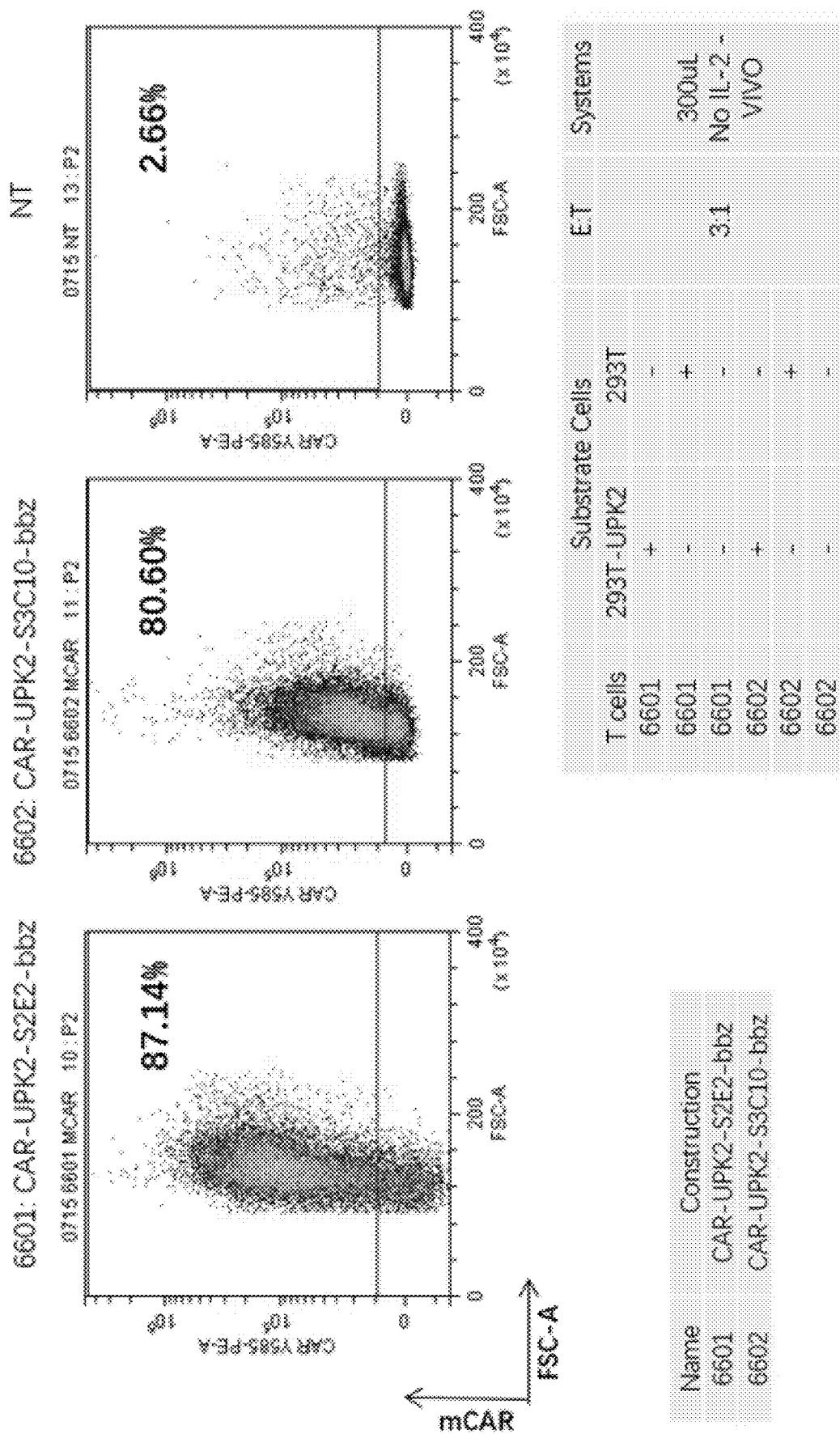
FIG. 15 shows UPK2 CAR expression by T cells.

FIG. 15 shows CAR expression by T cells. Further experiments were performed based on the steps described below. The cells were co-cultured for 24 hours and flow-stained with CAR+, and the supernatant was collected for detection of Cytometric Bead Array (CBA). The proliferation of CFES-stained T cells was observed.

Figure 16:
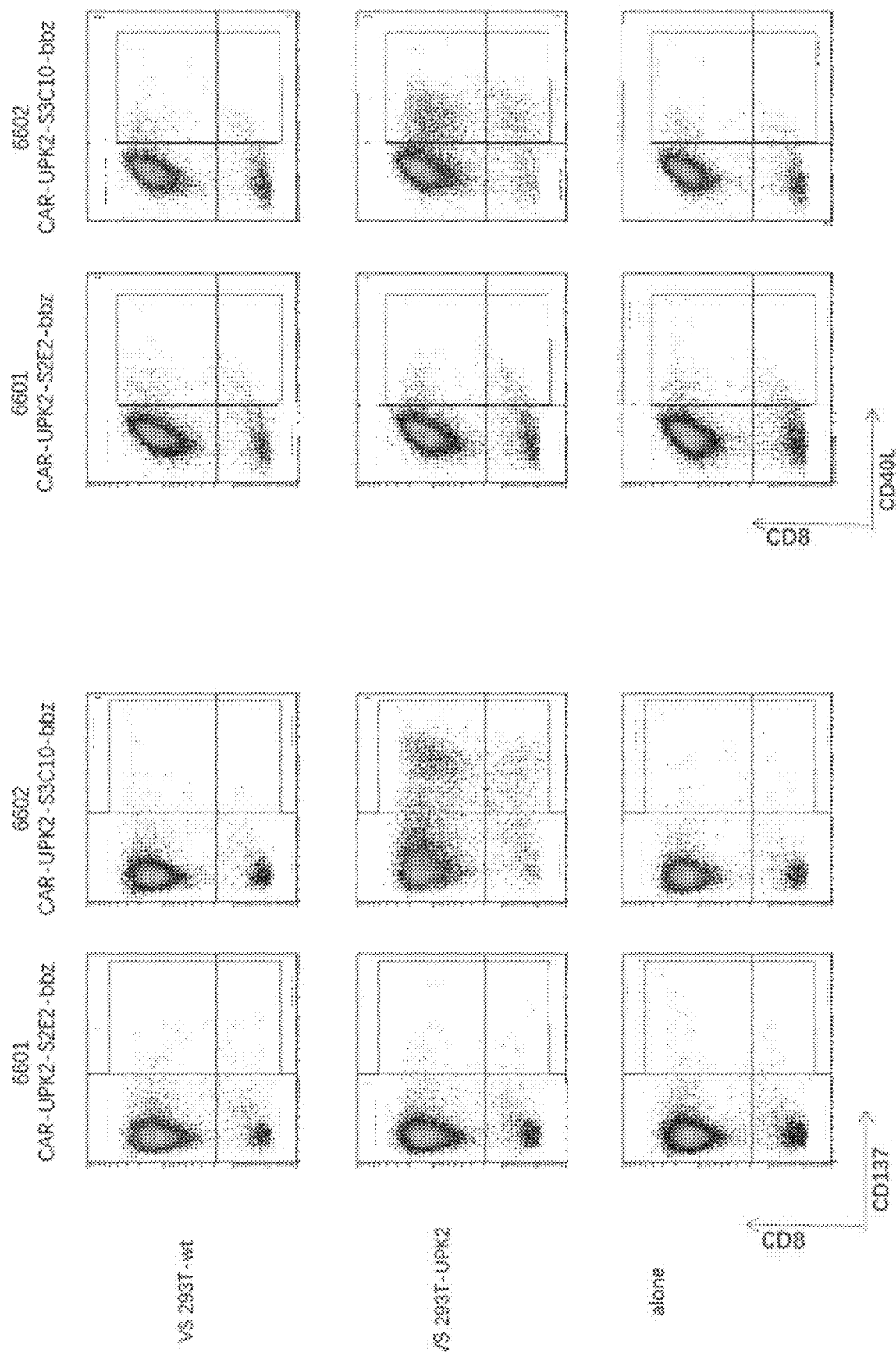
FIG. 16 shows flow cytometry analysis of UPK2 CAR T cells co-cultured with UPK2 positive cells.

FIG. 16 shows, after co-culture for 24 hours, flow cytometry results indicated that stimulation of 293T cells with UPK2 target cells could up-regulate the expression of CD137 and CD40L of T cells infected by S3C10 UPK2 CAR. These results show that S3C10 UPK2 CAR can recognize UPK2 target cells. Up-regulation of CD137 corresponds to activation of T cells, and expression of CD40L corresponds to activation of other immune cells of CD40+, such as DC cells, as shown in FIG. 16.

Figure 17:
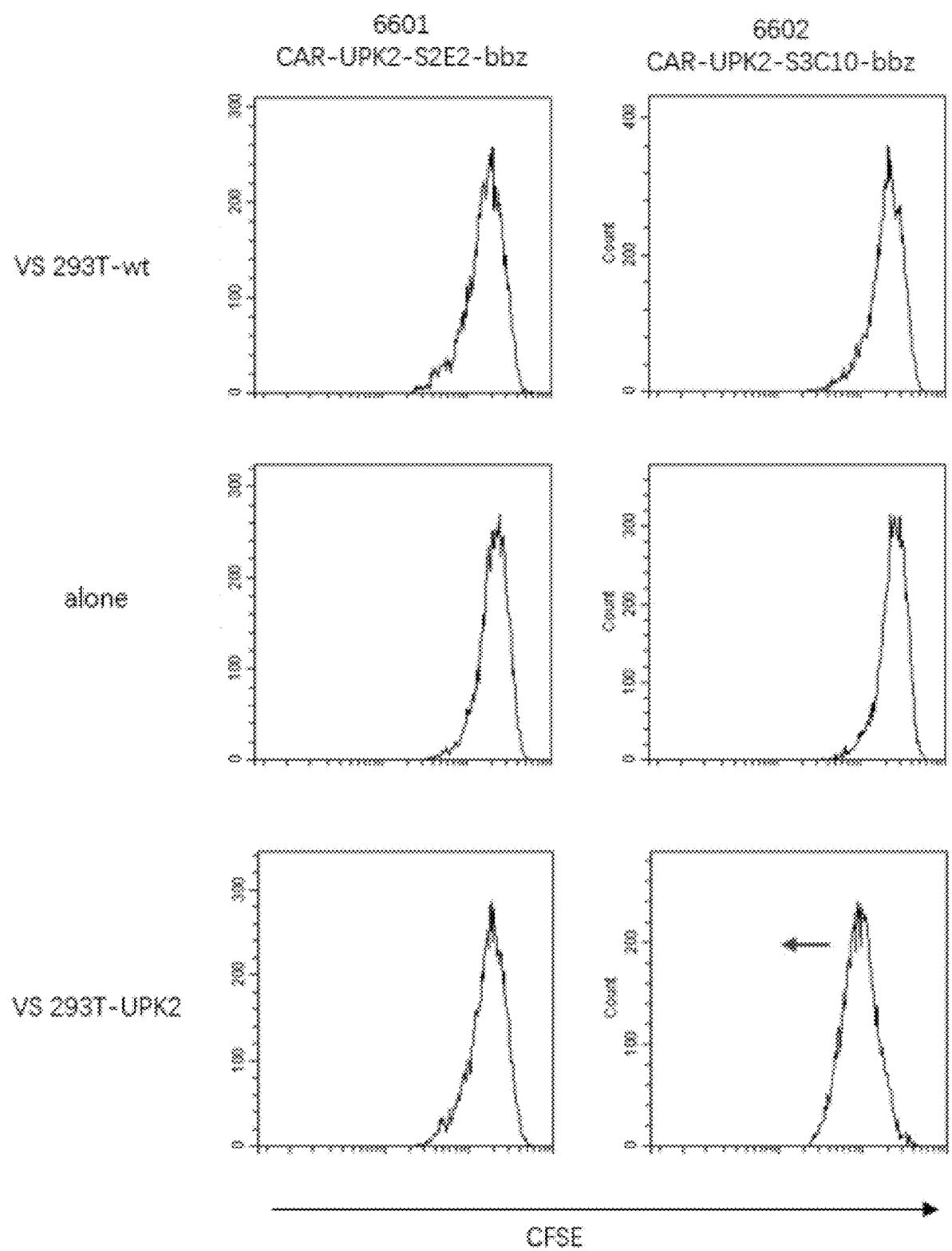
FIG. 17 shows proliferation of UPK2 CAR T cells co-cultured with UPK2 positive cells.

FIG. 17 shows proliferation of UPK2 CAR T cells after co-cultured with UPK2 positive cells. FIG. 18 shows cytokine release of UPK 2 CAR T cells after co-cultured with UPK2 positive cells. 293T cells with UPK2 target were able to stimulate proliferation of S3C10 UPK2 CAR-T cells and release IFN-γ and TNFα relative to the control group.

Figure 20:
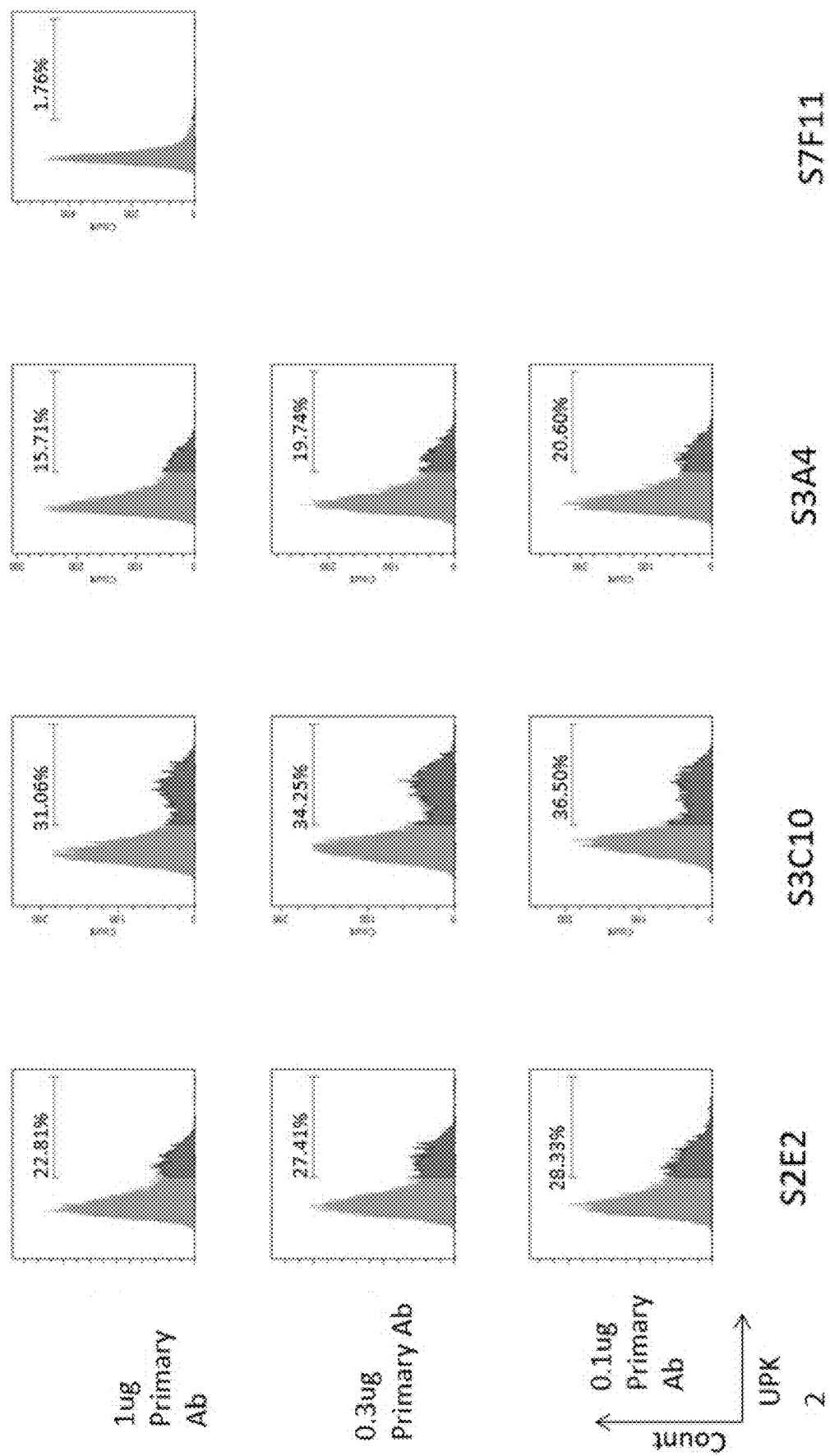
FIG. 20 shows flow cytometry analysis of cells expressing UPK2 antigen.
Figure 21:
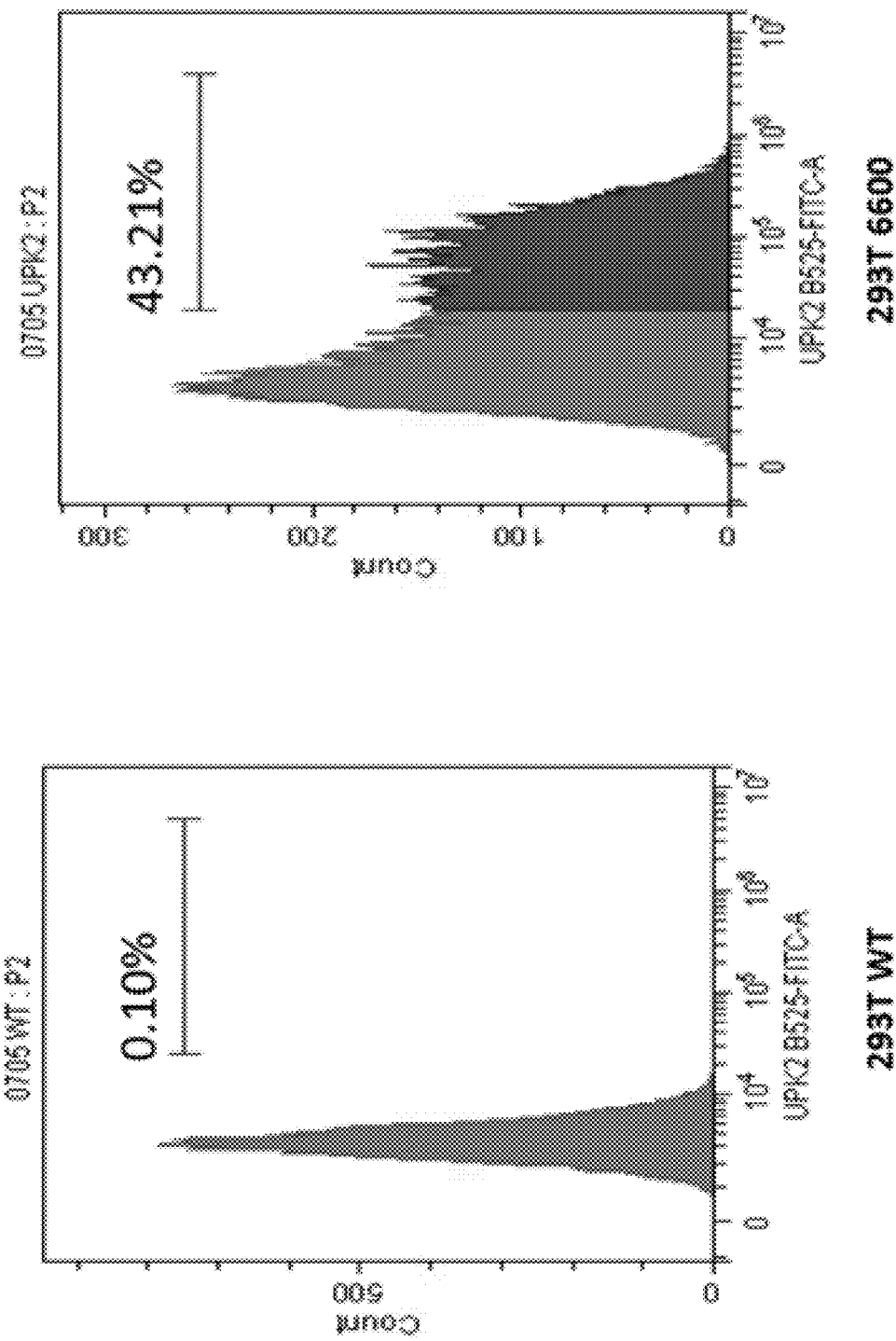
FIG. 21 shows flow cytometry analysis of cells expressing UPK2 antigen.

FIG. 19 shows transduction of 293T cells transiently using 6600 (Lenti-UPK2 antigen plasmid), and S2E2, S3C10, S3A4 antibodies showed signals. FIGS. 20 and 21 shows flow cytometry results that viruses were packaged using a 6600 plasmid (Lenti-UPK2 antigen expression plasmid). 293T cells were infected with the viruses, and UPK2-S3C10 antibody was used to detect the expression. UKP2 antigen expression was normal.

Example 4: Transduction and Expression of Mixed Vectors in T Cells

Lentiviral vectors that encode individual CAR molecules were generated and transfected with T cells, which are elaborated below. Techniques related to cell cultures, construction of cytotoxic T lymphocyte assay are described in "Control of large, established tumor xenografts with genetically retargeted human T cells containing CD28 and CD137 domains," PNAS, Mar. 3, 2009, vol. 106 no. 9, 3360-3365 and "Chimeric Receptors Containing CD137 Signal Transduction Domains Mediate Enhanced Survival of T Cells and Increased Antileukemic Efficacy In Vivo," Molecular Therapy, August 2009, vol. 17 no. 8, 1453-1464, which are incorporated herein by reference in their entirety.

On Day 0, peripheral blood was drawn from healthy volunteers. CD3+ T cells were sorted with pan T kit and activated by CD3/CD28 Dynabeads at a ratio of 3:1. Another group of cells was not activated by CD3/CD28 Dynabeads. On Day 1, the activated and non-activated CD3+ T cells were infected. These two groups of cells were infected with mixed vectors (i.e., Vectors 1-4) based on Table 6, and the remaining cells were used as NT (non-transfected). On Day 2, the lentivirus and the Dynabeads were removed, and the culture media were replaced. On Day 6, the CAR ratio and cell phenotype of CAR T cells were measured in each group using flow cytometry assay. Sequencing was performed on a total of 6395 non-activated T cells and 6271 activated T cells. FIG. 28 shows cell numbers and percentages of various non-activated T cells that expressed different molecules encoded by various vectors. FIG. 29 shows cell numbers and percentages of various activated T cells that expressed different molecules encoded by various vectors. As shown in FIGS. 28 and 29, it seemed that some cells (e.g., 2802, 2804, and 2902) were too few to be detected.

Figure 30:
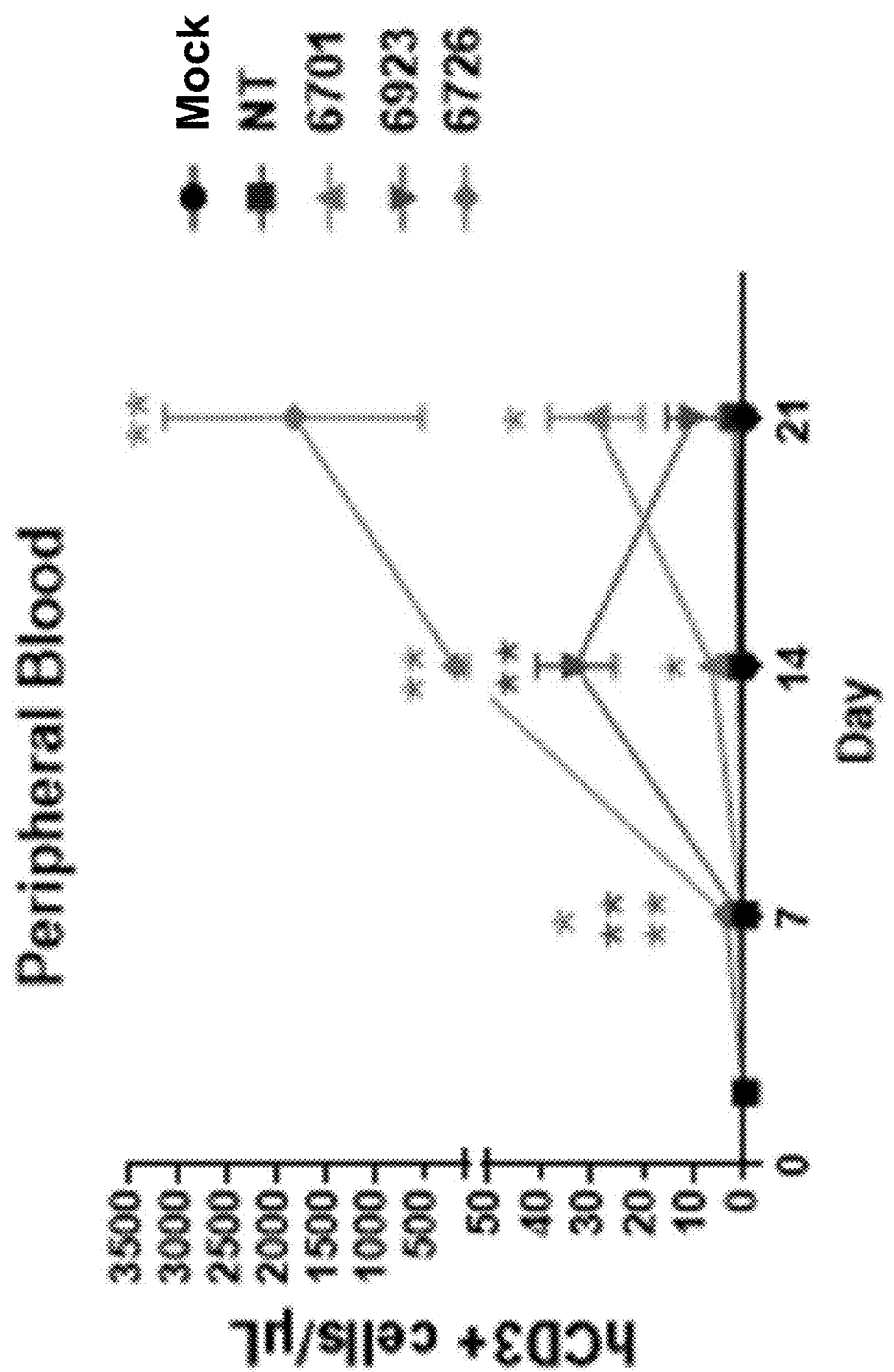
FIG. 30 shows T cell expansion in the peripheral blood of mice that were transplanted with tumor cells and then infused with CAR T cells.
Figure 31:
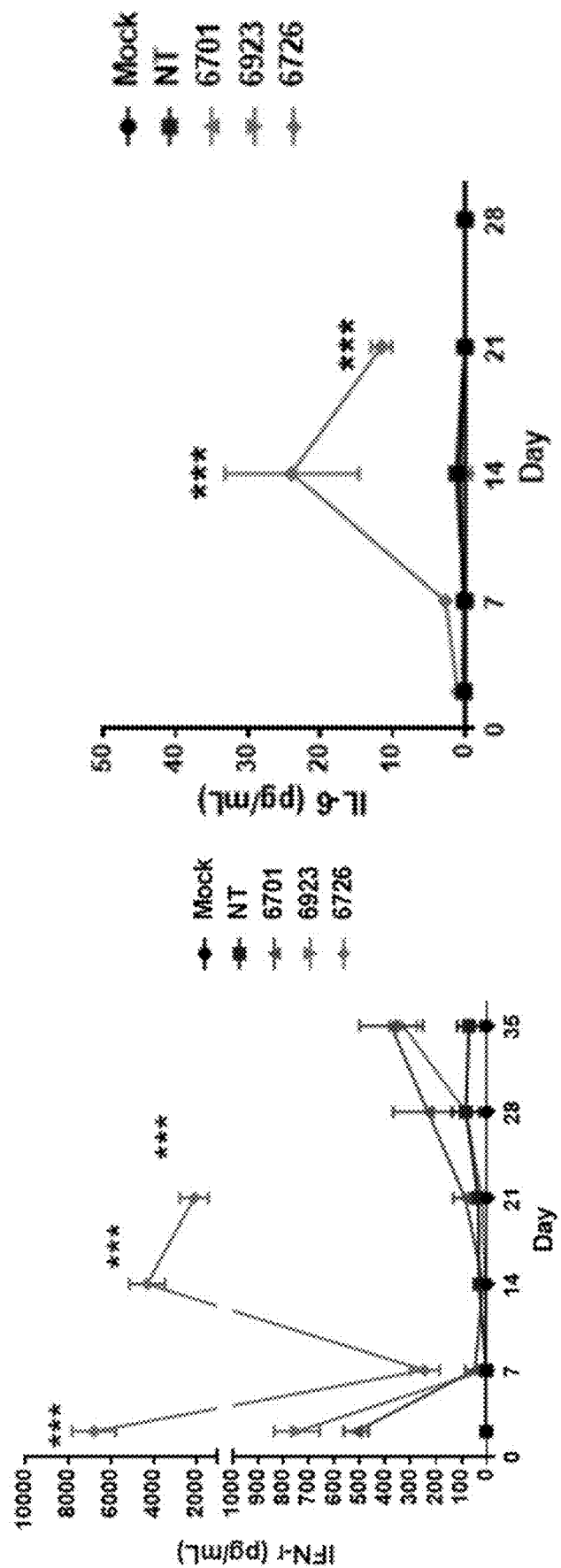
FIG. 31 shows cytokines released in the peripheral blood of mice that were transplanted with tumor cells and then infused with CAR T cells.

The activated T cells were infected with vectors 6726, 6923, and 6701, respectively, to generate various CAR T cells. Tumor cells (GCC positive cells) were transplanted into mice, and the CAR T cells were then infused into the mice, respectively. T cell expansion and cytokine release were measured. FIG. 30 shows T cell expansion in the peripheral blood of mice after various T cells infusion. FIG. 31 shows cytokine release measured in the peripheral blood of mice after various T cells infusion. As shown in FIGS. 30 and 31, expression of IL6 and IL12 enhanced T cell expansion and cytokine released.

TABLE 6

| Vector # | Vectors |
|---|---|
| 1 | GUCY2C-CAR (CAR: SEQ ID NO: 488, scFv of the CAR: SEQ ID NO: 11) |
| 2 | hCD19-CAR-IL6 |
| 3 | hCD19-CAR-IFNy |
| 4 | hCD19-CAR-IL12 |

TABLE 6-continued

| Vector # | Vectors |
|---|---|
| 6726 | IL12-VHL-2a-IL6 & GUCY2C-CAR (41-BB) |
| 6923 | GUCY2C-CAR (CD28) |
| 6701 | GUCY2C-CAR (41-BB) |

TABLE 7

Sequence IDs and corresponding identifiers

| Name | SEQ ID NO: | Name | SEQ ID NO: | Name | SEQ ID No: |
|---|---|---|---|---|---|
| SP | 1 | UPK2 | 101 | Construct of MUC1-5E5-A-IRES-CD19-A | 201 |
| Hinge & transmembrane domain | 2 | ADAM12 | 102 | CAR 1 of MUC1-5E5-A-IRES-CD19-A | 202 |
| Co-stimulatory domain | 3 | SLC45A3 | 103 | CAR 2 of MUC1-5E5-A-IRES-CD19-A | 203 |
| CD3-zeta | 4 | ACPP | 104 | Construct of MUC1-5E5-B-IRES-CD19-A | 204 |
| scFv Humanized CD19 | 5 | MUC21 | 105 | CAR 1 of MUC1-5E5-B-IRES-CD19-A | 205 |
| scFv CD19 | 6 | MUC16 | 106 | CAR 2 of MUC1-5E5-B-IRES-CD19-A | 203 |
| scFv FZD10 | 7 | MS4A12 | 107 | Construct of MUC1-5E5-A-IRES-CD19-B | 206 |
| scFv TSHR | 8 | ALPP | 108 | CAR 1 of MUC1-5E5-A-IRES-CD19-B | 202 |
| scFv PRLR | 9 | SLC2A14 | 109 | CAR 2 of MUC1-5E5-A-IRES-CD19-B | 207 |
| scFv Muc 17 | 10 | GS1-259H13.2 | 110 | Construct of MUC1-5E5-B-IRES-CD19-B | 208 |
| scFv GUCY2C | 11 | ERVFRD-1 | 111 | CAR 1 of MUC1-5E5-B-IRES-CD19-B | 205 |
| scFv CD207 | 12 | ADGRG2 | 112 | CAR 2 of MUC1-5E5-B-IRES-CD19-B | 207 |
| Prolactin (ligand) | 13 | ECEL1 | 113 | Construct of MUC1-2-A-IRES-CD19-A | 209 |
| scFv CD3 | 14 | CHRNA2 | 114 | CAR 1 of MUC1-2-A-IRES-CD19-A | 210 |
| scFv CD4 | 15 | GP2 | 115 | CAR 2 of MUC1-2-A-IRES-CD19-A | 203 |
| scFv CD4-2 | 16 | PSG9 | 116 | Construct of MUC1-2-B-IRES-CD19-A | 211 |
| scFv CD5 | 17 | SIGLEC15 | 117 | CAR 1 of MUC1-2-B-IRES-CD19-A | 212 |
| CD19 antigen | 18 | SLC6A3 | 118 | CAR 2 of MUC1-2-B-IRES-CD19-A | 203 |
| FZD10 antigen | 19 | KISS1R | 119 | Construct of MUC1-2-A-IRES-CD19-B | 213 |
| TSHR antigen | 20 | QRFPR | 120 | CAR 1 of MUC1-2-A-IRES-CD19-B | 210 |
| PRLR antigen | 21 | GPR119 | 121 | CAR 2 of MUC1-2-A-IRES-CD19-B | 207 |
| Muc 17 antigen | 22 | CLDN6 | 122 | Construct of MUC1-2-B-IRES-CD19-B | 214 |
| GUCY2C antigen | 23 | SP-2 | 123 | CAR 1 of MUC1-2-B-IRES-CD19-B | 212 |

TABLE 7-continued

Sequence IDs and corresponding identifiers

| Name | SEQ ID NO: | Name | SEQ ID NO: | Name | SEQ ID No: |
|---|---|---|---|---|---|
| CD207 antigen | 24 | Linker-2 | 124 | CAR 2 of MUC1-2-B-IRES-CD19-B | 207 |
| CD3 antigen | 25 | Hinge-2 | 125 | Construct of MUC1-5E5-A-IRES-hCD19-A | 215 |
| CD4 antigen | 26 | TM-2 | 126 | CAR 1 of MUC1-5E5-A-IRES-hCD19-A | 202 |
| CD5 antigen | 27 | 4-1BB-2 | 127 | CAR 2 of MUC1-5E5-A-IRES-hCD19-A | 216 |
| CAR CD19 nucleic acid | 28 | CD3 zeta-2 | 128 | Construct of MUC1-5E5-B-IRES-hCD19-A | 217 |
| Hinge & TM domain B | 29 | CLDN6-CAR-1 | 129 | CAR 1 of MUC1-5E5-B-IRES-hCD19-A | 205 |
| Hinge & TM domain A | 30 | ScFv CLDN6-CAR-1 | 130 | CAR 2 of MUC1-5E5-B-IRES-hCD19-A | 216 |
| Hinge & TM domain D | 31 | ScFv VL CLDN6-CAR-1 | 131 | Construct of MUC1-5E5-A-IRES-hCD19-B | 218 |
| Hinge & TM domain C | 32 | ScFv VH CLDN6-CAR-1 | 132 | CAR 1 of MUC1-5E5-A-IRES-hCD19-B | 202 |
| Hinge domain D | 33 | CLDN6-CAR-2 | 133 | CAR 2 of MUC1-5E5-A-IRES-hCD19-B | 219 |
| Hinge domain C | 34 | ScFv CLDN6-CAR-2 | 134 | Construct of MUC1-5E5-B-IRES-hCD19-B | 220 |
| Hinge domain B | 35 | ScFv VL CLDN6-CAR-2 | 135 | CAR 1 of MUC1-5E5-B-IRES-hCD19-B | 205 |
| Hinge domain A | 36 | ScFv VH CLDN6-CAR-2 | 136 | CAR 2 of MUC1-5E5-B-IRES-hCD19-B | 219 |
| TM domain D | 37 | CLDN6-CAR-3 | 137 | Construct of MUC1-2-A-IRES-hCD19-A | 221 |
| TM domain A | 38 | scFv CLDN6-CAR-3 | 138 | CAR 1 of MUC1-2-A-IRES-hCD19-A | 210 |
| CD19 extracellular domain | 39 | scFv VL CLDN6-CAR-3 | 139 | CAR 2 of MUC1-2-A-IRES-hCD19-A | 216 |
| TM domain C or B | 40 | scFv VH CLDN6-CAR-3 | 140 | Construct of MUC1-2-B-IRES-hCD19-A | 222 |
| WTCD3zeta | 41 | CLDN6-CAR-4 | 141 | CAR 2CAR 1 of MUC1-2-B-IRES-hCD19-A | 212 |
| WTCD3zeta-BCMACAR full length | 42 | scFv CLDN6-CAR-4 | 142 | Construct of MUC1-2-B-IRES-hCD19-A | 216 |
| BCMA | 43 | scFv VL CLDN6-CAR-4 | 143 | Construct of MUC1-2-A-IRES-hCD19-B | 223 |
| BCMA CAR vector | 44 | scFv VH CLDN6-CAR-4 | 144 | CAR 1 of MUC1-2-A-IRES-hCD19-B | 210 |
| BCMA CAR vector | 45 | SIGLEC-15-CAR-1 | 145 | CAR 2 of MUC1-2-A-IRES-hCD19-B | 219 |
| VL anti-CD5 | 46 | scFv SIGLEC-15-CAR-1 | 146 | Construct of MUC1-2-B-IRES-hCD19-B | 224 |
| VH anti-CD5 | 47 | scFv VL SIGLEC-15-CAR-1 | 147 | CAR 1 of MUC1-2-B-IRES-hCD19-B | 212 |
| VL anti-CD4 | 48 | scFv VH SIGLEC-15-CAR-1 | 148 | CAR 2 of MUC1-2-B-IRES-hCD19-B | 219 |
| VH anti-CD4 | 49 | VL1 VH1 SIGLEC-15-CAR-2 | 149 | Construct of MUC1-5E5-A-IRES-CD22-A | 225 |
| VL anti-CD3 | 50 | VL1 VH2 SIGLEC-15-CAR-3 | 150 | CAR 1 of MUC1-5E5-A-IRES-CD22-A | 202 |

TABLE 7-continued

Sequence IDs and corresponding identifiers

| Name | SEQ ID NO: | Name | SEQ ID NO: | Name | SEQ ID No: |
|---|---|---|---|---|---|
| VH anti-CD3 | 51 | VL1 VH3 SIGLEC-15-CAR-4 | 151 | CAR 2 of MUC1-5E5-A-IRES-CD22-A | 226 |
| TSHR extracellular domain | 52 | VL1 VH 4 SIGLEC-15-CAR-5 | 52 | Construct of MUC1-5E5-B-IRES-CD22-A | 227 |
| VH region of BCMA scFv | 53 | VL2 VH 1 SIGLEC-15-CAR-6 | 153 | CAR 1 of MUC1-5E5-A-IRES-CD22-A | 205 |
| VL region of BCMA scFv | 54 | VL2 VH2 SIGLEC-15-CAR-7 | 154 | CAR 2 of MUC1-5E5-A-IRES-CD22-A | 226 |
| VH region of CD14 scFv | 55 | VL2 VH3 SIGLEC-15-CAR-8 | 155 | Construct of MUC1-5E5-A-IRES-CD22-B | 228 |
| VL region of CD14 scFv | 56 | VL2 VH4 SIGLEC-15-CAR-9 | 156 | MUC1-5E5-A-IRES-CD22-B CAR 1 | 202 |
| VH region of CD33 scFv | 57 | VL1 SIGLEC-15-CAR | 157 | MUC1-5E5-A-IRES-CD22-B CAR 2 | 229 |
| VL region of CD33 scFv | 58 | VL2 SIGLEC-15-CAR | 158 | MUC1-5E5-B-IRES-CD22-B | 230 |
| CD22CAR | 59 | VH1 SIGLEC-15-CAR | 159 | CAR 1 of MUC1-5E5-B-IRES-CD22-B | 205 |
| BCMACAR | 60 | VH2 SIGLEC-15-CAR | 160 | CAR 2 of MUC1-5E5-B-IRES-CD22-B | 229 |
| MUC1CAR | 61 | VH3 SIGLEC-15-CAR | 161 | Construct of MUC1-2-A-IRES-CD22-A | 231 |
| m19CAR-IRES-MUC1CAR | 62 | VH4 SIGLEC-15-CAR | 162 | CAR 1 of MUC1-2-A-IRES-CD22-A | 210 |
| hCD19CAR-IRES-MUC1CAR | 63 | MUC16-CAR-1 | 163 | CAR 2 of MUC1-2-A-IRES-CD22-A | 226 |
| hCD22CAR-IRES-MUC1CAR | 64 | scFv MUC16-CAR-1 | 164 | MUC1-2-B-IRES-CD22-A | 232 |
| BCMACAR-IRES-MUC1CAR | 65 | scFv VL MUC16-CAR-1 | 165 | MUC1-2-B-IRES-CD22-A CAR 1 | 212 |
| mCD19CAR-2A-MUC1CAR | 66 | scFv VH MUC16-CAR-1 | 166 | MUC1-2-B-IRES-CD22-A CAR 2 | 226 |
| hCD19CAR-2A-MUC1CAR | 67 | MUC16-CAR-2 | 167 | MUC1-2-A-IRES-CD22-B | 233 |
| hCD22CAR-2A-MUC1CAR | 68 | scFv MUC16-CAR-2 | 168 | MUC1-2-A-IRES-CD22-B CAR 1 | 210 |
| BCMA-2A-MUC1CAR | 69 | scFv VL MUC16-CAR-2 | 169 | MUC1-2-A-IRES-CD22-B CAR 2 | 229 |
| Tumor associated MUC1 scFv 1 | 70 | scFv VH MUC16-CAR-2 | 170 | Construct of MUC1-2-B-IRES-CD22-B | 234 |
| Tumor associated MUC1 scFv-1 VH | 71 | KISS1R-CAR | 171 | CAR 1 of MUC1-2-B-IRES-CD22-B | 212 |
| Tumor associated MUC1 scFv-1 VL | 72 | Ligent peptide KISS1R-CAR | 172 | CAR 2 of MUC1-2-B-IRES-CD22-B | 229 |
| Tumor associated MUC1 scFv-1 VL CDR 1 | 73 | ZFLm1 (left) RS aa | 173 | Construct of MUC1-5E5-A-IRES-CD14-A | 235 |
| L2D8-2 (hCAR VL) | 74 | ZFLm1 (left) F1 | 174 | CAR 1 of MUC1-5E5-A-IRES-CD14-A | 202 |
| Tumor associated MUC1 scFv-1 VL CDR 3 | 75 | ZFLm1 (left) F2 | 174 | CAR 2 of MUC1-5E5-A-IRES-CD14-A | 236 |
| Tumor associated MUC1 scFv-1 VH CDR 1 | 76 | ZFLm1 (left) F3 | 176 | Construct of MUC1-5E5-B-IRES-CD14-A | 237 |
| Tumor associated MUC1 scFv-1 VH CDR 2 | 77 | ZFLm1 (left) F4 | 177 | CAR 1 of MUC1-5E5-B-IRES-CD14-A | 205 |
| Tumor associated MUC1 scFv-1 VH CDR 3 | 78 | ZFLm1 (left) F5 | 178 | CAR 2 of MUC1-5E5-B-IRES-CD14-A | 236 |

TABLE 7-continued

Sequence IDs and corresponding identifiers

| Name | SEQ ID NO: | Name | SEQ ID NO: | Name | SEQ ID No: |
|---|---|---|---|---|---|
| Tumor associated MUC1 scFv 2 | 79 | ZFLm1 (left) F6 | 179 | Construct of MUC1-5E5-A-IRES-CD14-B | 238 |
| Tumor associated MUC1 scFv2 VH | 80 | ZFRm1-4 (right) RS aa | 180 | CAR 1 of MUC1-5E5-A-IRES-CD14-B | 202 |
| Tumor associated MUC1 scFv2 VL | 81 | ZFRm1-4 (right) F1 | 181 | CAR 2 of MUC1-5E5-A-IRES-CD14-B | 239 |
| Tumor associated MUC1 scFv-2 VL CDR 1 | 82 | ZFRm1-4 (right) F2 | 182 | Construct of MUC1-2-A-IRES-CD14-A | 240 |
| Tumor associated MUC1 scFv-2 VL CDR 2 | 83 | ZFRm1-4 (right) F3 | 184 | CAR 1 of MUC1-2-A-IRES-CD14-A | 210 |
| Tumor associated MUC1 scFv-2 VL CDR 3 | 84 | ZFRm1-4 (right) F4 | 184 | CAR 2 of MUC1-2-A-IRES-CD14-A | 236 |
| Tumor associated MUC1 scFv-2VH CDR 1 | 85 | δ chain-1 of Vγ9Vδ2 | 185 | Construct of MUC1-2-B-IRES-CD14-A | 241 |
| Tumor associated MUC1 scFv-2 VH CDR 2 | 86 | γ chain-2 of Vγ9Vδ2 | 186 | CAR 1 of MUC1-2-B-IRES-CD14-A | 212 |
| Tumor associated MUC1 scFv-2 VH CDR 3 | 87 | δ chain-2 of Vγ9Vδ2 | 187 | CAR 2 of MUC1-2-B-IRES-CD14-A | 236 |
| GSTA motif | 88 | Vγ9Vδ2 TCR-1: DG. SF13 γ chain | 188 | Construct of MUC1-2-A-IRES-CD14-B | 242 |
| Modified PD-1 intracellular domain-1 | 89 | Vγ9Vδ2 TCR-1: DG. SF13 δ chain | 189 | CAR 1 of MUC1-2-A-IRES-CD14-B | 210 |
| Modified PD-1 intracellular domain-2 | 90 | Vγ9Vδ2 TCR-2: DG. SF68: γ chain | 190 | CAR 2 of MUC1-2-A-IRES-CD14-B | 239 |
| Modified PD-1 intracellular domain-3 | 91 | Vγ9Vδ2 TCR-2: DG. SF68: δ chain | 191 | Construct of MUC1-2-B-IRES-CD14-B | 243 |
| Modified PD-1 intracellular domain-4 | 92 | Vγ9Vδ2 TCR-3: 12G12: γ chain | 192 | CAR 1 of MUC1-2-B-IRES-CD14-B | 212 |
| Modified PD-1 intracellular domain-5 | 93 | Vγ9Vδ2 TCR-3: 12G12: δ chain | 193 | CAR 2 of MUC1-2-B-IRES-CD14-B | 239 |
| Removed PD-1 intracellular domain-1 | 94 | Vγ9Vδ2 TCR-4: CP.1.15 γ chain | 194 | Construct of MUC1-5E5-A-IRES-BCMA-A | 244 |
| Removed PD-1 intracellular domain-2 | 95 | TCR-4: CP.1.150 chain | 195 | CAR 1 of MUC1-5E5-A-IRES-BCMA-A | 202 |
| FokI WC | 96 | WT CD3-zeta | 196 | CAR 2 of MUC1-5E5-A-IRES-BCMA-A | 245 |
| M FokI | 97 | Invariant sequence for INKT α chain (hVα24-JαQ-TRAC) | 197 | Construct of MUC1-5E5-B-IRES-BCMA-A | 246 |
| M FokI | 98 | An example for iNKT β chain sequence (containing Vβ11): | 198 | CAR 1 of MUC1-5E5-B-IRES-BCMA-A | 205 |
| γ chain-1 of Vγ9Vδ2 | 99 | Invariant sequence for MAIT α chain (hAV7S2-AJ33 α chain) (version1) | 199 | CAR 2 of MUC1-5E5-B-IRES-BCMA-A | 245 |
| VL anti-CD4-2 | 100 | VH anti-CD4-2 | 200 | Construct of MUC1-5E5-A-IRES-BCMA-B | 247 |
| CAR 1 of MUC1-2-A-IRES-CD33-A | 210 | CAR 1 of MUC1-5E5-B-IRES-CD33-A | 205 | CAR 1 of MUC1-5E5-A-IRES-BCMA-B | 202 |
| CAR 2 of MUC1-2-A-IRES-CD33-A | 255 | CAR 2 of MUC1-5E5-B-IRES-CD33-A | 255 | CAR 2 of MUC1-5E5-A-IRES-BCMA-B | 248 |

TABLE 7-continued

Sequence IDs and corresponding identifiers

| Name | SEQ ID NO: | Name | SEQ ID NO: | Name | SEQ ID No: |
|---|---|---|---|---|---|
| Construct of MUC1-2-B-IRES-CD33-A | 261 | Construct of MUC1-5E5-A-IRES-CD33-B | 257 | Construct of MUC1-5E5-B-IRES-BCMA-B | 249 |
| CAR 1 of MUC1-2-B-IRES-CD33-A | 212 | CAR 1 of MUC1-5E5-A-IRES-CD33-B | 202 | CAR 1 of MUC1-5E5-B-IRES-BCMA-B | 205 |
| CAR 2 of MUC1-2-B-IRES-CD33-A | 255 | CAR 2 of MUC1-5E5-A-IRES-CD33-B | 258 | CAR 2 of MUC1-5E5-B-IRES-BCMA-B | 245 |
| Construct of MUC1-2-A-IRES-CD33-B | 262 | Construct of MUC1-5E5-B-IRES-CD33-B | 259 | Construct of MUC1-2-A-IRES-BCMA-A | 250 |
| CAR 1 of MUC1-2-A-IRES-CD33-B | 210 | CAR 1 of MUC1-5E5-B-IRES-CD33-B | 205 | CAR 1 of MUC1-2-A-IRES-BCMA-A | 210 |
| CAR 2 of MUC1-2-A-IRES-CD33-B | 258 | CAR 2 of MUC1-5E5-B-IRES-CD33-B | 258 | CAR 2 of MUC1-2-A-IRES-BCMA-A | 245 |
| Construct of MUC1-2-B-IRES-CD33-B | 263 | Construct of MUC1-2-A-IRES-CD33-A | 260 | Construct of MUC1-2-B-IRES-BCMA-A | 251 |
| CAR 1 of MUC1-2-B-IRES-CD33-B | 212 | Construct of MUC1-2-B-IRES-BCMA-B | 253 | CAR 1 of MUC1-2-B-IRES-BCMA-A | 212 |
| CAR 2 of MUC1-2-B-IRES-CD33-B | 258 | CAR 1 of MUC1-2-B-IRES-BCMA-B | 212 | CAR 2 of MUC1-2-B-IRES-BCMA-A | 245 |
| Construct of MUC1-5E5-A-IRES-CD33-A | 254 | MUC1-2-B-IRES-BCMA-B CAR 2 | 248 | Construct of MUC1-2-A-IRES-BCMA-B | 252 |
| CAR 1 of MUC1-5E5-A-IRES-CD33-A | 202 | MUC1-5E5-B-IRES-CD33-A | 256 | CAR 1 of MUC1-2-A-IRES-BCMA-B | 210 |
| CAR 2 of MUC1-5E5-A-IRES-CD33-A | 255 | CAR 2 of MUC1-2-A-IRES-BCMA-B | 248 | Mcu1-5e5Panko-enhanced scFc | 264 |
| Mcu1-Panko5e5-enhanced scFc | 265 | hinge and/or transmembrane domain A | 266 | hinge and/or transmembrane domain B | 267 |
| hinge and/or transmembrane domain C | 268 | hinge and/or transmembrane domain D | 269 | Mcu1-5e5Panko-enhanced scFc A 41BB CD2 zeta | 270 |
| Mcu1-5e5Panko-enhanced scFc B 41BB CD2 zeta | 271 | Mcu1-5e5Panko-enhanced scFc C 41BB CD2 zeta | 272 | Mcu1-5e5Panko-enhanced scFc D 41BB CD2 zeta | 273 |
| Mcu1-Panko5e5-enhanced scFc A 41BB CD2 zeta | 274 | Mcu1-Panko5e5-enhanced scFc B 41BB CD2 zeta | 275 | Mcu1-Panko5e5-enhanced scFc C 41BB CD2 zeta | 276 |
| Mcu1-Panko5e5-enhanced scFc D 41BB CD2 zeta | 277 | GS linker | 278 | Construct of TSHR CAR | 279 |
| M FokI-1 | 280 | M FokI-2 | 281 | FokI WC | 282 |
| PSCA-CAR ScFv | 356 | CD8sp | 428 | Anti-TSHR-VL | 429 |
| 3*GGGGS linker | 278 | Anti-TSHR-VH | 430 | 4*GGGGS bispecific CAR linker | 431 |
| humanized-anti CD19-VH | 432 | humanized-anti CD19-VL | 433 | B7-H3 scFv 1 | 434 |
| B7-H3 scFv 2 | 435 | B7-H3 scFv 3 | 436 | Anti-CLDN 18.2 (175)-VL | 437 |
| Anti-CLDN 18.2 (175)-VH | 438 | CLDN 18.2 (175) CAR Binding domain | 439 | | |
| tMUC1-CLDN 18.2 tanCAR binding domain 175/5e5LH | 440 | tMUC1-CLDN 18.2 tanCAR 5e5/175LH-1 | 452 | scfv TSHR LH | 466 |
| tMUC1-CLDN 18.2 tanCAR binding domain 175/5e5HL | 441 | tMUC1-CLDN 18.2 tanCAR 5e5/175HL-1 | 453 | scfv TSHR HL | 467 |

TABLE 7-continued

Sequence IDs and corresponding identifiers

| Name | SEQ ID NO: | Name | SEQ ID NO: | Name | SEQ ID No: |
|---|---|---|---|---|---|
| tMUC1-CLDN 18.2 tanCAR binding domain 163/5e5LH | 442 | tMUC1-CLDN 18.2 tanCAR 5e5/163LH-1 | 454 | scfv GUCY2C LH | 468 |
| tMUC1-CLDN 18.2 tanCAR binding domain 163/5e5HL | 443 | tMUC1-CLDN 18.2 tanCAR 5e5/163HL-1 | 455 | scfv GUCY2C HL | 469 |
| tMUC1-CLDN 18.2 tanCAR binding domain 5e5/175LH | 444 | tMUC1-CLDN 18.2 tanCAR 175/5e5LH-2 | 456 | scfv ACPP LH | 470 |
| tMUC1-CLDN 18.2 tanCAR binding domain 5e5/175HL | 445 | tMUC1-CLDN 18.2 tanCAR 175/5e5HL-2 | 457 | scfv ACPP HL | 471 |
| tMUC1-CLDN 18.2 tanCAR binding domain 5e5/163LH | 446 | tMUC1-CLDN 18.2 tanCAR 163/5e5LH-2 | 458 | scfv UPK2 LH (1) | 472 |
| tMUC1-CLDN 18.2 tanCAR binding domain 5e5/163HL | 447 | tMUC1-CLDN 18.2 tanCAR 163/5e5HL-2 | 459 | scfv UPK2 HL (1) | 473 |
| tMUC1-CLDN 18.2 tanCAR 175/5e5LH-1 | 448 | tMUC1-CLDN 18.2 tanCAR 5e5/175LH-2 | 460 | scfv UPK2 LH (2) | 474 |
| tMUC1-CLDN 18.2 tanCAR 175/5e5HL-1 | 449 | tMUC1-CLDN 18.2 tanCAR 5e5/175HL-2 | 461 | scfv UPK2 HL (2) | 475 |
| tMUC1-CLDN 18.2 tanCAR 163/5e5LH-1 | 450 | tMUC1-CLDN 18.2 tanCAR 5e5/163LH-2 | 462 | scfv PSMA LH | 476 |
| tMUC1-CLDN 18.2 tanCAR 163/5e5HL-1 | 451 | tMUC1-CLDN 18.2 tanCAR 5e5/163HL-2 | 463 | scfv PSMA HL | 477 |
| scfv CD19 HL | 465 | scfv CD19 LH | 464 | anti CXCR5 Scfv | 478 |
| Anti DPEP3 Scfv | 479 | hCD19-CAR (4-1BB + CD3 zeta)-NATF-IL6-2A-IFNγ | 480 | NFAT6x + minimal IL12 promoter | 481 |
| IL-6 aa Sequence | 482 | 2A | 483 | IFN-γ aa | 484 |
| hCD19-CAR (4-1BB + CD3 zeta)-NATF-IL12-VHL | 485 | IL12 aa | 486 | Hif VHL-interaction domain: Hif amino acid 344-417 | 487 |
| GUCY2C-CAR | 488 | scFv 6503 S5D1 | 489 | 163: cldn18.2 scfv: CD8-signal peptide + cldn18.2VL + GS linker + cldn18.2VH | 490 |
| 6921: ACPP scFv: CD8-signal peptide + acpp-VL + GS linker + acpp-VH | 491 | 2517: tMUC1, cldn18.2 tanCAR | 492 | 2519: tMUC1, cldn18.2 tanCAR | 493 |
| 2521: TSHR, tMUC1 tanCAR | 494 | 2529: ACPP, tMUC1 tanCAR | 495 | 2530: ACPP, tMUC1 tanCAR | 496 |
| 2533: ACPP, tMUC1 tanCAR | 497 | 2534: ACPP, tMUC1 tanCAR | 498 | scFv target PSMA | 499 |
| scFv target Mesothelin | 500 | scFv target EGFRvIII | 501 | scFv target CEA | 502 |
| scFv target Glypican-3 | 503 | scFv target IL-13 | 504 | NFAT-IL7-VHL-CCL19-VHL | 505 |
| NFAT-CCL19-VHL-IL7-VHL | 506 | hCD19CAR | 507 | NFAT DNA | 508 |
| IL7 DNA | 509 | CCL19 DNA | 510 | VHL DNA | 511 |
| F2A DNA | 512 | Anti-CD205 scFv 1 | 513 | UPK2 DNA | 514 |
| ACPP-41bb-CD3z CAR aa | 515 | ACPP-CD28-CD3z CAR aa | 516 | ACPP-41bb-CD3z-furin gsg t2a-RQR8 | 517 |
| RQR8-furin gsg t2a-ACPP-41bb-CD3z | 518 | ACPP-CD28-CD3z-furin gsg t2a-RQR8 | 519 | RQR8-furin gsg t2a-ACPP-CD28-CD3z | 520 |
| Anti-CD205 VH | 521 | Anti-CD205 scFv 2 | 522 | Anti-CD205 CAR 4-1BB | 523 |

TABLE 7-continued

Sequence IDs and corresponding identifiers

| Name | SEQ ID NO: | Name | SEQ ID NO: | Name | SEQ ID No: |
|---|---|---|---|---|---|
| Anti-CD205 CAR CD28 | 524 | IL2v aa | 525 | Anti-CD205 VL | 526 |
| GCSF | 527 | UPK2 S2E2-bbz CAR | 528 | UPK2 S2E2-28z CAR | 529 |
| UPK2 S3C10-bbz CAR | 530 | UPK2 S3C10-28z CAR | 531 | CD19 CAR 2 | 532 |
| TSHR CAR 2 | 533 | GCC CAR 2 | 534 | | |

All publications, patents and patent applications cited in this specification are incorporated herein by reference in their entireties as if each individual publication, patent or patent application were specifically and individually indicated to be incorporated by reference. While the foregoing has been described in terms of various embodiments, the skilled artisan will appreciate that various modifications, substitutions, omissions, and changes may be made without departing from the spirit thereof.

SEQUENCE LISTING (534 sequences)

SEQ ID NO: 1 - protein, 21 aa, Artificial Sequence
  Synthesized
MALPVTALLLPLALLLHAARP

SEQ ID NO: 2 - protein, 69 aa, Artificial Sequence
  Synthesized
AKPTTTPAPRPPTPAPTIASQPLSLRPEACRPAAGGAVHTRGLDFACDIYIWAPLAGTCGVLLLSLVIT

SEQ ID NO: 3 - protein, 42 aa, Artificial Sequence
  Synthesized
KRGRKKLLYIFKQPFMRPVQTTQEEDGCSCRFPEEEEGGCEL

SEQ ID NO: 4 - protein, 112 aa, Artificial Sequence
  Synthesized
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 5 - protein, 242 aa, Artificial Sequence
  Synthesized
DIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIKGGGGSGGGGSGGGGSEVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSS

SEQ ID NO: 6 - protein, 242 aa, Artificial Sequence
  Synthesized
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 7 - protein, 237 aa, Artificial Sequence
  Synthesized
DIQMTQSPASLSVSVGETVTITCRASENIYSNLAWYQQKQGKSPQLLVYVATNLADGVPSRFSGSGSGTQYSLKINSLQSEDFGSYYCQHFWGTPYTFGGGTKLGGGGSGGGGSGGGGSEVQLQQSGAELVKPGASVKLSCTASGFNINDTYMHWVKQRPEQGLEWIGRIDPANGNTKYDPKFQGKATITADTSSNTAYLQLSSLTSEDTAVYYCARGARGSRFAYWGQGTLVTVSA

SEQ ID NO: 8 - protein, 244 aa, Artificial Sequence
  Synthesized
QSVLTQPPSVSAAPGQKVTISCSGSSSDIGSNYVSWYQQFPGTAPKLLIYDNNKRPSAIPDRFSGSKSGTSATLGITGLQTGDEADYYCGTWDSRLGIAVFGGGTQLTVLGGGGSGGGGSGGGGSEVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSS

SEQ ID NO: 9 - protein, 252 aa, Artificial Sequence
  Synthesized
DIVLTQSPASLAVSLGQGATISCRASKSVSTSGYTYMHWYQQKPGQPPKLLIYLASNLESGVPARFSGSGSGTDFTLNIHPVEEEDAATYYCQHSGELPPSFGGGTKLEIKRAGGGGSGGGGSGGGGSEVQLVESGGDLVKPGGSLKLSCAVSGFTFSSYGMSWVRQTPDKRLEWVATVSSGGTYTYYPDSVKGRFTISRDNAKNTLYLQMSSLKSEDSAMYYCARHRGNYYATYYYAMDYWGQGTSVTVSS

SEQ ID NO: 10 - protein, 243 aa, Artificial Sequence
  Synthesized
DVQITQSPSYLAASPGETITINCRASKSISKYLAWYQEKPGKTNKLLIYSGSTLQSGIPSRFSGSGSGTDFTLTISSLEPEDFAMYYCQQHHEYPYTFGGGTKLEIKGGGGSGGGGSGGGGSQVQLQQPGAELVRPGASVKLSCKASGYTFTTYWMNWVKQRPEQGLEWIGRIDPYDSETHYNQKFKDKAILTVDKSSSTAYMQLSSLTSEDSAVYYCARGPYYGTNPWFPYWGQGTLVTVSS

SEQ ID NO: 11 - protein, 241 aa, Artificial Sequence
  Synthesized
EIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSS

SEQ ID NO: 12 - protein, 246 aa, Artificial Sequence
  Synthesized
DVVMTQTPLSLPVRLGDQASISCRSSQSLVHSNGNTYLHWYLQKPGQSPKLLIYKVSNRFSGVPDRFSGSGSGTNFTLKISRVEAEDLGLYFCSQSTHVPYTFGGGTKLEIKRAGGGGSGGGGSGGGGSQVQLRQSGPELVKPGASVKMSCKASGYTFTDYVISWVKQRTGQGLEWIGDIYPGSGYSFYNENFKGKATLTADKSSTTAYMQLSSLTSEDSAVYFCATYYNYPFAYWGQGTLVTVSA

SEQ ID NO: 13 - protein, 199 aa, Artificial Sequence
  Synthesized
LPICPGGAARCQVTLRDLFDRAVVLSHYIHNLSSEMFSEFDKRYTHGRGFITKAINSCHTSSLATPEDKEQAQQMNQKDFLSLIVSILRSWNEPLYHLVTEVRGMQEAPEAILSKAVEIEEQTKRLLEGMELIVSQVHPETKENEIYPVWSGLPSLQMADEESRLSAYYNLLHCLRRDSHKIDNYLKLLKCRIIHNNNC

SEQ ID NO: 14 - protein, 240 aa, Artificial Sequence
  Synthesized
DIVMTQSPDSLAVSLGERATINCKSSQSLLNSRTRKNYLAWYQQKPGQPPKLLIYWASTRESGVPDRFSGSGSGTDFTLTISSLQAEDVAVYYCTQSFILRTFGQGTKVEIKGGGGGSGGGGSGGGGSDIVMTQSPDSLAVSLGERATINCKSSQSLLNSRTRKNYLAWYQQKPGQPPKLLIYWASTRESGVPDRFSGSGSGTDFTLTISSLQAEDVAVYYCTQSFILRTFGQGTKVEIK

SEQ ID NO: 15 - protein, 281 aa, Artificial Sequence
  Synthesized
MNVPTQLLGLLLLWLTGGKCDIQMTQSPASLSASLEEIVTITCKASQAIDAYLSWYQQKPGKSPQLLIYDATSLADGVPSRFSGSRSGTQYSLKISRPQVDDSGIYYCLQSYSTPFTFGSGTKLEIKGGGGGSGGGGSGGGGSMAVLVLLLCLLIFPSCVLSQVQLKESGPGLVQPSQTLSLTCTVSGSSLTSNSVSWIRQPPGKGLEWMGVIWSNGDADYNSAIKSRLSISRDTSKSQVFLKMNSLQTEDTAMYFCASPYYGYYFPFDYWGQGVMVTVSS

SEQ ID NO: 16 - protein, 285 aa, Artificial Sequence
  Synthesized
METDTLLLWVLLLWVPGSTGDIVLTQSPALAVSLGQRATISCRASQSVSISSHDLMQWYQQKPGQQPKLLIYDAFNLASGIPVRFSGSGSGTDFTLTIDPVQADDIATYYCQQSKDDPYTFGAGTKLELKGGGGGSGGGGSGGGGSMDIRLSLAFLVLFIKGVQCEVQLVESGGGLVQPGRSMKLSCAASGFTFSNYGMAWVRQAPTKGLEWVATISYDGSITYYRDSVKGRFTISRDHAKSTLYLQMNSLRSEDTATYYCTREEQYSSWYFDFWGPGIMVTVSS

SEQ ID NO: 17 - protein, 242 aa, Artificial Sequence
  Synthesized
NIVMTQSPSSLSASVGDRVTITCQASQDVGTAVAWYQQKPDQSPKLLIYWTSTRHTGVPDRFTGSGSGTDFTLTISSLQPEDIATYFCHQYNSYNTFGSGTKLEIKGGGGGSGGGGSGGGGSQVTLKESGPVLVKPTETLTLTCTFSGFSLSTSGMGVGWIRQAPGKGLEWVAHIWWDDDVYYNPSLKSRLTITKDASKDQVSLKLSSVTAADTAVYYCVRRRATGTGFDYWGQGTLVTVSS

SEQ ID NO: 18 - protein, 272 aa, Homo sapiens
PEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWK

SEQ ID NO: 19 - protein, 205 aa, Homo sapiens
ISSMDMERPGDGKCQPIEIPMCKDIGYNMTRMPNLMGHENQREAAIQLHEFAPLVEYGCHGHLRFFLCSLYAPMCTEQVSTPIPACRVMCEQARLKCSPIMEQFNFKWPDSLDCRKLPNKNDPNYLCMEAPNNGSDEPTRGSGLFPPLFRPQRPHSAQEHPLKDGGPGRGGCDNPGKFHHVEKSASCAPLCTPGVDVYWSREDKR

SEQ ID NO: 20 - protein, 393 aa, Homo sapiens
GMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMG

SEQ ID NO: 21 - protein, 210 aa, Homo sapiens
QLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMND

SEQ ID NO: 22 - protein, 4368 aa, Homo sapiens
EQDLSVNRAVWDGGGCISQGDVLNRQCQQLSQHVRTGSAANTATGTTSTNVVEPRMYLSCSTNPEMTSIESSVTSDTPGVSSTRMTPTESRTTSESTSDSTTLFPSSTEDTSSPTTPEGTDVPMSTPSEESISSTMAFVSTAPLPSFEAYTSLTYKVDMSTPLTTSTQASSSPTTPESTTIPKSTNSEGSTPLTSMPASTMKVASSEAITLLTTPVEISTPVTISAQASSSPTTAEGPSLSNSAPSGGSTPLTRMPLSVMLVVSSEASTLSTTPAATNIPVITSTEASSSPTTAEGTSIPTSTYTEGSTPLTSTPASTMPVATSEMSTLSITPVDTSTLVTTSTEPSSLPTTAEATSMLTSTLSEGSTPLTNMPVSTILVASSEASTTSTIPVDSKTFVTTASEASSSPTTAEDTSIATSTPSEGSTPLTSMPVSTTPVASSEASNLSTTPVDSKTQVTTSTEASSSPPTAEVNSMPTSTPSEGSTPLTSMSVSTMPVASSEASTLSTTPVDTSTPVTTSSEASSSSTTPEGTSIPTSTPSEGSTPLTNMPVSTRLVVSSEASTTSTTPADSNTFVTTSSEASSSSTTAEGTSMPTSTYSERGTTITSMSVSTTLVASSEASTLSTTPVDSNTPVTTSTEATSSSTTAEGTSMPTSTYTEGSTPLTSMPVNTTLVASSEASTLSTTPVDTSTPVTTSTEASSSPTTADGASMPTSTPSEGSTPLTSMPVSKTLLTSSEASTLSTTPLDTSTHITTSTEASCSPTTTEGTSMPISTPSEGSPLLTSIPVSITPVTSPEASTLSTTPVDSNSPVTTSTEVSSSPTPAEGTSMPTSTYSEGRTPLTSMPVSTTLVATSAISTLSTTPVDTSTPVTNSTEARSSPTTSEGTSMPTSTPGEGSTPLTSMPDSTTPVVSSEARTLSATPVDTSTPVTTSTEATSSPTTAEGTSIPTSTPSEGTTPLTSTPVSHTLVANSEASTLSTTPVDSNTPLTTSTEASSPPPTAEGTSMPTSTPSEGSTPLTRMPVSTTMVASSETSTLSTTPADTSTPVTTYSQASSSSTTADGTSMPTSTYSEGSTPLTSVPVSTRLVVSSEASTLSTTPVDTSIPVTTSTEASSSPTTAEGTSIPTSPPSEGTTPLASMPVSTTLVVSSEANTLSTTPVDSKTQVATSTEASSPPPTAEVTSMPTSTPGERSTPLTSMPVRHTPVASSEASTLSTSPVDTSTPVTTSAETSSSPTTAEGTSLPTSTTSEGSTLLTSIPVSTTLVTSPEASTLLTTPVDTKGPVVTSNEVSSSPTPAEGTSMPTSTYSEGRTPLTSIPVNTTLVASSAISILSTTPVDNSTPVTTSTEACSSPTTSEGTSMPNSNPSEGTTPLTSIPVSTTPVVSSEASTLSATPVDTSTPGTTSAEATSSPTTAEGISIPTSTPSEGKTPLKSIPVSNTPVANSEASTLSTTPVDSNSPVVTSTAVSSSPTPAEGTSIAISTPSEGSTALTSIPVSTTTVASSEINSLSTTPAVTSTPVTTYSQASSSPTTADGTSMQTSTYSEGSTPLTSLPVSTMLVVSSEANTLSTTPIDSKTQVTASTEASSSTTAEGSSMTISTPSEGSPLLTSIPVSTTPVASPEASTLSTTPVDSNSPVITSTEVSSSPTPAEGTSMPTSTYTEGRTPLTSITVRTTPVASSAISTLSTTPVDNSTPVTTSTEARSSPTTSEGTSMPNSTPSEGTTPLTSIPVSTTPVLSSEASTLSATPIDTSTPVTTSTEATSSPTTAEGTSIPTSTLSEGMTPLTSTPVSHTLVANSEASTLSTTPVDSNSPVVTSTAVSSSPTPAEGTSIATSTPSEGSTALTSIPVSTTTVASSETNTLSTTPAVTSTPVTTYAQVSSSPTTADGSSMPTSTPREGRPPLTSIPVSTTTVASSEINTLSTTLADTRTPVTTYSQASSSPTTADGTSMPTPAYSEGSTPLTSMPLSTTLVVSSEASTLSTTPVDTSTPATTSTEGSSSPTTAGGTSIQTSTPSERTTPLAGMPVSTTLVVSSEGNTLSTTPVDSKTQVTNSTEASSSATAEGSSMTISAPSEGSPLLTSIPLSTTPVASPEASTLSTTPVDSNSPVITSTEVSSSPIPTEGTSMQTSTYSDRRTPLTSMPVSTTVVASSAISTLSTTPVDTSTPVTNSTEARSSPTTSEGTSMPTSTPSEGSTPFTSMPVSTMPVVTSEASTLSATPVDTSTPVTTSTEATSSPTTAEGTSIPTSTLSEGTTPLTSIPVSHTLVANSEVSTLSTTPVDSNTPFTTSTEASSPPPTAEGTSMPTSTSSEGNTPLTRMPVSTTMVASFETSTLSTTPADTSTPVTTYSQAGSSPTTADDTSMPTSTYSEGSTPLTSVPVSTMPVVSSEASTHSTTPVDTSTPVTTSTEASSSPTTAEGTSIPTSPPSEGTTPLASMPVSTTPVVSSEAGTLSTTPVDTSTPMTTSTEASSSPTTAEDIVVPISTASEGSTLLTSIPVSTTPVASPEASTLSTTPVDSNSPVVTSTEISSSATSAEGTSMPTSTYSEGSTPLRSMPVSTKPLASSEASTLSTTPVDTSIPVTTSTETSSSPTTAKDTSMPISTPSEVSTSLTSILVSTMPVASSEASTLSTTPVDTRTLVTTSTGTSSSPTTAEGSSMPTSTPGERSTPLTNILVSTTLLANSEASTLSTTPVDTSTPVTTSAEASSSPTTAEGTSMRISTPSDGSTPLTSILVSTLPVASSEASTVSTTAVDTSIPVTTSTEASSSPTTAEVTSMPTSTPSETSTPLTSMPVNHTPVASSEAGTLSTTPVDTSTPVTTSTKASSSPTTAEGIVVPISTASEGSTLLTSIPVSTTPVASSEASTLSTTPVDTSIPVTTSTEGSSSPTTAEGTSMPISTPSEVSTPLTSILVSTVPVAGSEASTLSTTPVDTRTPVTTSAEASSSPTTAEGTSMPISTPGERRTPLTSMSVSTMPVASSEASTLSRTPADTSTPVTTSTEASSSPTTAEGTGIPISTPSEGSTPLTSIPVSTTPVAIPEASTLSTTPVDSNSPVVTSTEVSSSPTPAEGTSMPISTYSEGSTPLTGVPVSTTPVTSSAISTLSTTPVDTSTPVTTSTEAHSSPTTSEGTSMPTSTPSEGSTPLTYMPVSTMLVVSSEDSTLSATPVDTSTPVTTSTEATSSTTAEGTSIPTSTPSEGMTPLTSVPVSNTPVASSEASILSTTPVDSNTPLTTSTEASSSPPTAEGTSMPTSTPSEGSTPLTSMPVSTTTVASSETSTLSTTPADTSTPVTTYSQASSSPPIADGTSMPTSTYSEGSTPLTNMSFSTTPVVSSEASTLSTTPVDTSTPVTTSTEASLSPTTAEGTSIPTSSPSEGTTPLASMPVSTTPVVSSEVNTLSTTPVDSNTLVTTSTEASSSPTIAEGTSLPTSTTSEGSTPLSIMPLSTTPVASSEASTLSTTPVDTSTPVTTSSPTNSSPTTAEVTSMPTSTAGEGSTPLTNMPVSTTPVASSEASTLSTTPVDSNTFVTSSSQASSSPATLQVTTMRMSTPSEGSSSLTTMLLSSTYVTSSEASTPSTPSVDRSTPVTTSTQSNSTPTPPEVITLPMSTPSEVSTPLTIMPVSTTSVTISEAGTASTLPVDTSTPVITSTQVSSSPVTPEGTTMPIWTPSEGSTPLTTMPVSTTRVTSSEGSTLSTPSVVTSTPVTTSTEAISSSATLDSTTMSVSMPMEISTLGTTILVSTTPVTRFPESSTPSIPSVYTSMSMTTASEGSSSPTTLEGTTTMPMSTTSERSTLLTTVLISPISVMSPSEASTLSTPPGDTSTPLLTSTKAGSFSIPAEVTTIRISITSERSTPLTTLLVSTTLPTSFPGASIASTPPLDTSTTFTPSTDTASTPTIPVATTISVSVITEGSTPGTTIFIPSTPVTSSTADVFPATTGAVSTPVITSTELNTPSTSSSSTTTSFSTTKEFTTPAMTTAAPLTYVTMSTAPSTPRTTSRGCTTSASTLSATSTPHTSTSVTTRPVTPSSESSRPSTITSHTIPPTFPPAHSSTPPTTSASSTTVNPEAVTTMTTRTKPSTRTTSFPTVTTTAVPTNTTIKSNPTSTPTVPRTTTCFGDGCQNTASRCKNGGTWDGLKCQCPNLYYGELCEEVVSSIDIGPPETISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKSLVYG

SEQ ID NO: 23 - protein, 407 aa, Homo sapiens
SQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQ

SEQ ID NO: 24 - protein, 264 aa, Homo sapiens
PRFMGTISDVKTNVQLLKGRVDNISTLDSEIKKNSDGMEAAGVQIQMVNESLGYVRSQFLKLKTSVEKANAQIQILTRSWEEVSTLNAQIPELKSDLEKASALNTKIRALQGSLENMSKLLKRQNDILQVVSQGWKYFKGNFYYFSLIPKTWYSAEQFCVSRNSHLTSVTSESEQEFLYKTAGGLIYWIGLTKAGMEGDWSWVDDTPFNKVQSVRFWIPGEPNNAGNNEHCGNIKAPSLQAWNDAPCDKTFLFICKRPYVPSEP

SEQ ID NO: 25 - protein, 100 aa, Homo sapiens
DGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENC

SEQ ID NO: 26 - protein, 371 aa, Homo sapiens
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQP

SEQ ID NO: 27 - protein, 348 aa, Homo sapiens
RLSWYDPDFQARLTRSNSKCQGQLEVYLKDGWHMVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFRKIKPQKSGRVLALLCSGFQPKVQSRLVGGSSICEGTVEVRQGAQWAALCDSSSARSSLRWEEVCREQQCGSVNSYRVLDAGDPTSRGLFCPHQKLSQCHELWERNSYCKKVFVTCQDPNP

SEQ ID NO: 28 - DNA, 7902 bp, Artificial Sequence
  Synthesized
gtcgacactagtaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgccgcggaattcgagctcggtacctttaagaccaatgacttacaaggcagctgtagatcttagccactttttaaaagaaaaggggggactggaagggctaattcactcccaacgaagacaagatctgctttttgcttgtactgagtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggctctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacggctctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgatcacgagactagcctcgacacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagaaatccactttggctcgagaagcttgatatcggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcc

SEQ ID NO: 29 - protein, 66 aa, Artificial Sequence
  Synthesized
TTTPAPRPPTPAPTIASQPLSLRPEACRPAAGGAVHTRGLDFACDIYIWAPLAGTCGVLLLSLVIT

SEQ ID NO: 30 - protein, 69 aa, Artificial Sequence
  Synthesized
TTTPAPRPPTPAPTIASQPLSLRPEACRPAAGGAVHTRGLDFACDIYIWAPLAGTCGVLLLSLVITLYC

SEQ ID NO: 31 - protein, 72 aa, Artificial Sequence
  Synthesized
AKPTTTPAPRPPTPAPTIASQPLSLRPEACRPAAGGAVHTRGLDFACDIYIWAPLAGTCGVLLLSLVITLYC

SEQ ID NO: 32 - protein, 69 aa, Artificial Sequence; identical to SEQ ID NO: 2
  Synthesized

SEQ ID NO: 33 - protein, 50 aa, Artificial Sequence
  Synthesized
AKPTTTPAPRPPTPAPTIASQPLSLRPEACRPAAGGAVHTRGLDFACDIY

SEQ ID NO: 34 - protein, 50 aa, Artificial Sequence; identical to SEQ ID NO: 33
  Synthesized

SEQ ID NO: 35 - protein, 47 aa, Artificial Sequence
  Synthesized
TTTPAPRPPTPAPTIASQPLSLRPEACRPAAGGAVHTRGLDFACDIY

SEQ ID NO: 36 - protein, 47 aa, Artificial Sequence; identical to SEQ ID NO: 35
  Synthesized

SEQ ID NO: 37 - protein, 22 aa, Artificial Sequence
  Synthesized
IWAPLAGTCGVLLLSLVITLYC

SEQ ID NO: 38 - protein, 22 aa, Artificial Sequence
  Synthesized
IWAPLAGTCGVLLLSLVITLYC

SEQ ID NO: 39 - protein, 120 aa, Artificial Sequence
  Synthesized
PEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNR

SEQ ID NO: 40 - protein, 19 aa, Artificial Sequence
  Synthesized
IWAPLAGTCGVLLLSLVIT

SEQ ID NO: 41 - DNA, 339 bp, Artificial Sequence
  Synthesized
agagtgaagttcagcaggagcgcagacgcccccgcgtaccagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 42 - DNA, 1689 bp, Artificial Sequence
  Synthesized
cggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 43 - DNA, 1689 bp, Homo sapiens
cggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 44 - DNA, 1689 bp, Artificial Sequence; identical to SEQ ID NO: 42
  Synthesized

SEQ ID NO: 45 - DNA, 1689 bp, Artificial Sequence; identical to SEQ ID NO: 43
  Synthesized

SEQ ID NO: 46 - protein, 106 aa, Artificial Sequence
  Synthesized
NIVMTQSPSSLSASVGDRVTITCQASQDVGTAVAWYQQKPDQSPKLLIYWTSTRHTGVPDRFTGSGSGTDFTLTISSLQPEDIATYFCHQYNSYNTFGSGTKLEIK

SEQ ID NO: 47 - protein, 120 aa, Artificial Sequence
  Synthesized
QVTLKESGPVLVKPTETLTLTCTFSGFSLSTSGMGVGWIRQAPGKGLEWVAHIWWDDDVYYNPSLKSRLTITKDASKDQVSLKLSSVTAADTAVYYCVRRRATGTGFDYWGQGTLVTVSS

SEQ ID NO: 48 - protein, 130 aa, Artificial Sequence
  Synthesized
METDTLLLWVLLLWVPGSTGDIVLTQSPALAVSLGQRATISCRASQSVSISSHDLMQWYQQKPGQQPKLLIYDAFNLASGIPVRFSGSGSGTDFTLTIDPVQADDIATYYCQQSKDDPYTFGAGTKLELK

SEQ ID NO: 49 - protein, 139 aa, Artificial Sequence
  Synthesized
MDIRLSLAFLVLFIKGVQCEVQLVESGGGLVQPGRSMKLSCAASGFTFSNYGMAWVRQAPTKGLEWVATISYDGSITYYRDSVKGRFTISRDHAKSTLYLQMNSLRSEDTATYYCTREEQYSSWYFDFWGPGIMVTVSS

SEQ ID NO: 50 - protein, 112 aa, Artificial Sequence
  Synthesized
DIVMTQSPDSLAVSLGERATINCKSSQSLLNSRTRKNYLAWYQQKPGQPPKLLIYWASTRESGVPDRFSGSGSGTDFTLTISSLQAEDVAVYYCTQSFILRTFGQGTKVEIK

SEQ ID NO: 51 - protein, 119 aa, Artificial Sequence
  Synthesized
EVQLVQSGAEVKKPGASVKVSCKASGYTFTNYYIHWVRQAPGQGLEWIGWIYPGDGNTKYNEKFKGRATLTADTSTSTAYLELSSLRSEDTAVYYCARDSYSNYYFDYWGQGTLVTVSS

SEQ ID NO: 52 - protein, 413 aa, Artificial Sequence
  Synthesized
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMG

SEQ ID NO: 53 - protein, 115 aa, Artificial Sequence
  Synthesized
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSS

SEQ ID NO: 54 - protein, 108 aa, Artificial Sequence
  Synthesized
EIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIK

SEQ ID NO: 55 - protein, 140 aa, Artificial Sequence
  Synthesized
MGWSCIILFLVATATGVHSEVQLVESGGGLMQPKGSLKLSCAASGFTFKTYALNWVRQAPGTGLEWVARIRSKSNNYTTYYADSVKDRFTISRDDSQNMLYLQMNNLKTEDTAMYYCVRPQSGTSFAYWGQGTLVTVSAA

SEQ ID NO: 56 - protein, 131 aa, Artificial Sequence
  Synthesized
MGWSCIILFLVATATGVHSNIVLTQSPASLAVSLGQRATISCRASESVDSYGNSFMHWYQQKPGQPPKLLIYLASNLESGVPARFSGSGSRTDFTLTIDPVEADDVATYYCQQNNGDPYTFGGGTKLEIIR

SEQ ID NO: 57 - protein, 120 aa, Artificial Sequence
  Synthesized
QVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSS

SEQ ID NO: 58 - protein, 111 aa, Artificial Sequence
  Synthesized
EIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIK

SEQ ID NO: 59 - DNA, 1473 bp, Artificial Sequence
  Synthesized
atggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 60 - DNA, 1446 bp, Artificial Sequence
  Synthesized
atggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 61 - DNA, 1467 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 62 - DNA, 3533 bp, Artificial Sequence
  Synthesized
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 63 - DNA, 3533 bp, Artificial Sequence
  Synthesized
atggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 64 - DNA, 3545 bp, Artificial Sequence
  Synthesized
atggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 65 - DNA, 3518 bp, Artificial Sequence
  Synthesized
atggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 66 - DNA, 2994 bp, Artificial Sequence
  Synthesized
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 67 - DNA, 2994 bp, Artificial Sequence
  Synthesized
atggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 68 - DNA, 3009 bp, Artificial Sequence
  Synthesized
atggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 69 - DNA, 2982 bp, Artificial Sequence
  Synthesized
atggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 70 - protein, 244 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 71 - protein, 116 aa, Artificial Sequence
  Synthesized
QVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 72 - protein, 113 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELK

SEQ ID NO: 73 - protein, 12 aa, Artificial Sequence
  Synthesized
QSLLNSGDQKNY

SEQ ID NO: 74 - protein, 107 aa, Artificial Sequence
  Synthesized
DIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIK

SEQ ID NO: 75 - protein, 9 aa, Artificial Sequence
  Synthesized
QNDYSYPLT

SEQ ID NO: 76 - protein, 8 aa, Artificial Sequence
  Synthesized
GYTFTDHA

SEQ ID NO: 77 - protein, 8 aa, Artificial Sequence
  Synthesized
FSPGNTDI

SEQ ID NO: 78 - protein, 9 aa, Artificial Sequence
  Synthesized
KTSTFFFDY

SEQ ID NO: 79 - protein, 246 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSS

SEQ ID NO: 80 - protein, 117 aa, Artificial Sequence
  Synthesized
EVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSS

SEQ ID NO: 81 - protein, 114 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRA

SEQ ID NO: 82 - protein, 16 aa, Artificial Sequence
  Synthesized
RSSKSLLHSNGITYFF

SEQ ID NO: 83 - protein, 7 aa, Artificial Sequence
  Synthesized
QMSNLAS

SEQ ID NO: 84 - protein, 9 aa, Artificial Sequence
  Synthesized
AQNLELPPT

SEQ ID NO: 85 - protein, 5 aa, Artificial Sequence
  Synthesized
NYWMN

SEQ ID NO: 86 - protein, 19 aa, Artificial Sequence
  Synthesized
EIRLKSNNYTTHYAESVKG

SEQ ID NO: 87 - protein, 6 aa, Artificial Sequence
  Synthesized
HYYFDY

SEQ ID NO: 88 - protein, 4 aa, Artificial Sequence
  Synthesized
GSTA

SEQ ID NO: 89 - protein, 97 aa, Artificial Sequence
  Synthesized
CSRAARGTIGARRTGQPLKEDPSAVPVFSVDAGELDFQWREKTPEPPVPCVPEQTEAATIVFPSGMGTSSPARRGSADGPRSAQPLRPEDGHCSWPL

SEQ ID NO: 90 - protein, 17 aa, Artificial Sequence
  Synthesized
CSRAARGTIDGHCSWPL

SEQ ID NO: 91 - protein, 21 aa, Artificial Sequence
  Synthesized
VGVVGGLLGSLVLLVWVLAVI

SEQ ID NO: 92 - protein, 18 aa, Artificial Sequence
  Synthesized
GNILNVSIKICLTLSPST

SEQ ID NO: 93 - protein, 9 aa, Artificial Sequence
  Synthesized
CSRAARGTI

SEQ ID NO: 94 - protein, 80 aa, Artificial Sequence
  Synthesized
GARRTGQPLKEDPSAVPVFSVDYGELDFQWREKTPEPPVPCVPEQTEYATIVFPSGMGTSSPARRGSADGPRSAQPLRPE

SEQ ID NO: 95 - protein, 80 aa, Artificial Sequence; identical to SEQ ID NO: 94
  Synthesized

SEQ ID NO: 96 - protein, 196 aa, Artificial Sequence
  Synthesized
QLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINF

SEQ ID NO: 97 - protein, 196 aa, Artificial Sequence
  Synthesized
QLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVKENQTRNKHINPNEWWKVYPSSVTEFKFLFVSGHFKGNYKAQLTRLNHKTNCNGAVLSVEELLIGGEMIKAGTLTLEEVRRKFNNGEINF

SEQ ID NO: 98 - protein, 196 aa, Artificial Sequence
  Synthesized
QLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMERYVEENQTRNKHLNPNEWWKVYPSSVTEFKFLFVSGHFKGNYKAQLTRLNHITNCNGAVLSVEELLIGGEMIKAGTLTLEEVRRKFNNGEINF

SEQ ID NO: 99 - protein, 323 aa, Artificial Sequence [sequence omitted]

SEQ ID NO: 100 - protein, 127 aa, Artificial Sequence
  Synthesized
MNVPTQLLGLLLLWLTGGKCDIQMTQSPASLSASLEEIVTITCKASQAIDAYLSWYQQKPGKSPQLLIYDATSLADGVPSRFSGSRSGTQYSLKISRPQVDDSGIYYCLQSYSTPFTFGSGTKLEIK

SEQ ID NO: 101 - protein, 184 aa, Homo sapiens
MAPLLPIRTLPLILILLALLSPGAADFNISSLSGLLSPALTESLLVALPPCHLTGGNATLMVRRANDSKVVTSSFVVPPCRGRRELVSVVDSGAGFTVTRLSAYQVTNLVPGTKFYISYLVKKGTATESSREIPMSTLPRRNMESIGLGMARTGGMVVITVLLSVAMFLLVLGFIIALALGSRK

SEQ ID NO: 102 - protein, 909 aa, Homo sapiens
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTVILGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 103 - protein, 553 aa, Homo sapiens
MVQRLWVSRLLRHRKAQLLLVNLLTFGLEVCLAAGITYVPPLLLEVGVEEKFMTMVLGIGPVLGLVCVPLLGSASDHWRGRYGRRRPFIWALSLGILLSLFLIPRAGWLAGLLCPDPRPLELALLILGVGLLDFCGQVCFTPLEALLSDLFRDPDHCRQAYSVYAFMISLGGCLGYLLPAIDWDTSALAPYLGTQEECLFGLLTLIFLTCVAATLLVAEEAALGPTEPAEGLSAPSLSPHCCPCRARLAFRNLGALLPRLHQLCCRMPRTLRRLFVAELCSWMALMTFTLFYTDFVGEGLYQGVPRAEPGTEARRHYDEGVRMGSLGLFLQCAISLVFSLVMDRLVQRFGTRAVYLASVAAFPVAAGATCLSHSVAVVTASAALTGFTFSALQILPYTLASLYHREKQVFLPKYRGDTGGASSEDSLMTSFLPGPKPGAPFPNGHVGAGGSGLLPPPPALCGASACDVSVRVVVGEPTEARVVPGRGICLDLAILDSAFLLSQVAPSLFMGSIVQLSQSVTAYMVSAAGLGLVAIYFATQVVFDKSDLAKYSA

SEQ ID NO: 104 - protein, 418 aa, Homo sapiens
MRAAPLLLARAASLSLGFLFLLFFWLDRSVLAKELKFVTLVFRHGDRSPIDTFPTDPIKESSWPQGFGQLTQLGMEQHYELGEYIRKRYRKFLNESYKHEQVYIRSTDVDRTLMSAMTNLAALFPPEGVSIWNPILLWQPIPVHTVPLSEDQLLYLPFRNCPRFQELESETLKSEEFQKRLHPYKDFIATLGKLSGLHGQDLFGIWSKVYDPLYCESVHNFTLPSWATEDTMTKLRELSELSLLSLYGIHKQKEKSRLQGGVLVNEILNHMKRATQIPSYKKLIMYSAHDTTVSGLQMALDVYNGLLPPYASCHLTELYFEKGEYFVEMYYRNETQHEPYPLMLPGCSPSCPLERFAELVGPVIPQDWSTECMTTNSHQVLKVIFAVAFCLISAVLMVLLFIHIRRGLCWQRESYGNI

SEQ ID NO: 105 - protein, 560 aa, Homo sapiens
MKMQKGNVLLMFGLLLHLEAATNSNETSTSANTGSSVISSGASTATNSGSSVTSSGVSTATISGSSVTSNGVSIVTNSEFHTTSSGISTATNSEFSTVSSGISIATNSESSTTSSGASTATNSESSTPSSGASTATNSDSSTTSSGASTATNSDSSTTSSEASTATNSESSTTSSGASTATNSESSTVSSRASTATNSESSTTSSGASTATNSESRTTSNGAGTATNSESSTTSSGASTATNSESSTPSSGAGTATNSESSTTSSGAGTATNSESSTVSSGISTVTNSESSTPSSGANTATNSESSTTSSGANTATNSDSSTTSSGASTATNSESSTTSSGASTATNSESSTTSSGASTATNSGSSTTSSGTSTATNSESSTVSSGASTATTSESSTTSSGASTATNSESSTVSSGASTATNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMS

SEQ ID NO: 106 - protein, 14507 aa, Homo sapiens
MLKPSGLPGSSSPTRSLMTGSRSTKATPEMDSGLTGATLSPKTSTGAIVVTEHTLPFTSPDKTLASPTSSVVGRTTQSLGVMSSALPESTSRGMTHSEQRTSPSLSPQVNGTPSRNYPATSMVSGLSSPRTRTSSTEGNFTKEASTYTLTVETTSGPVTEKYTVPTETSTTEGDSTETPWDTRYIPVKITSPMKTFADSTASKENAPVSMTPAETTVTDSHTPGRTNPSFGTLYSSFLDLSPKGTPNSRGETSLELILSTTGYPFSSPEPGSAGHSRISTSAPLSSSASVLDNKISETSIFSGQSLTSPLSPGVPEARASTMPNSAIPFSMTLSNAETSAERVRSTISSLGTPSISTKQTAETILTFHAFAETMDIPSTHIAKTLASEWLGSPGTLGGTSTSALTTTSPSTTLVSEETNTHHSTSGKETEGTLNTSMTPLETSAPGEESEMTATLVPTLGFTTLDSKIRSPSQVSSSHPTRELRTTGSTSGRQSSSTAAHGSSDILRATTSSTSKASSWTSESTAQQFSEPQHTQWVETSPSMKTERPPASTSVAAPITTSVPSVVSGFTTLKTSSTKGIWLEETSADTLIGESTAGPTTHQFAVPTGISMTGGSSTRGSQGTTHLLTRATASSETSADLTLATNGVPVSVSPAVSKTAAGSSPPGGTKPSYTMVSSVIPETSSLQSSAFREGTSLGLTPLNTRHPFSSPEPDSAGHTKISTSIPLLSSASVLEDKVSATSTFSHHKATSSITTGTPEISTKTKPSSAVLSSMTLSNAATSPERVRNATSPLTHPSPSGEETAGSVLTLSTSAETTDSPNIHPTGTLTSESSESPSTLSLPSVSGVKTTFSSSTPSTHLFTSGEETEETSNPSVSQPETSVSRVRTTLASTSVPTPVFPTMDTWPTRSAQFSSSHLVSELRATSSTSVTNSTGSALPKISHLTGTATMSQTNRDTFNDSAAPQSTTWPETSPRFKTGLPSATTTVSTSATSLSATVMVSKFTSPATSSMEATSIREPSTTILTTETTNGPGSMAVASTNIPIGKGYITEGRLDTSHLPIGTTASSETSMDFTMAKESVSMSVSPSQSMDAAGSSTPGRTSQFVDTFSDDVYHLTSREITIPRDGTSSALTPQMTATHPPSPDPGSARSTWLGILSSSPSSPTPKVTMSSTFSTQRVTTSMIMDTVETSRWNMPNLPSTTSLTPSNIPTSGAIGKSTLVPLDTPSPATSLEASEGGLPTLSTYPESTNTPSIHLGAHASSESPSTIKLTMASVVKPGSYTPLTFPSIETHIHVSTARMAYSSGSSPEMTAPGETNTGSTWDPTTYITTTDPKDTSSAQVSTPHSVRTLRTTENHPKTESATPAAYSGSPKISSSPNLTSPATKAWTITDTTEHSTQLHYTKLAEKSSGFETQSAPGPVSVVIPTSPTIGSSTLELTSDVPGEPLVLAPSEQTTITLPMATWLSTSLTEEMASTDLDISSPSSPMSTFAIFPPMSTPSHELSKSEADTSAIRNTDSTTLDQHLGIRSLGRTGDLTTVPITPLTTTWTSVIEHSTQAQDTLSATMSPTHVTQSLKDQTSIPASASPSHLTEVYPELGTQGRSSSEATTFWKPSTDTLSREIETGPTNIQSTPPMDNTTTGSSSSGVTLGIAHLPIGTSSPAETSTNMALERRSSTATVSMAGTMGLLVTSAPGRSISQSLGRVSSVLSESTTEGVTDSSKGSSPRLNTQGNTALSSSLEPSYAEGSQMSTSIPLTSSPTTPDVEFIGGSTFWTKEVTTVMTSDISKSSARTESSSATLMSTALGSTENTGKEKLRTASMDLPSPTPSMEVTPWISLTLSNAPNTTDSLDLSHGVHTSSAGTLATDRSLNTGVTRASRLENGSDTSSKSLSMGNSTHTSMTYTEKSEVSSSIHPRPETSAPGAETTLTSTPGNRAISLTLPFSSIPVEEVISTGITSGPDINSAPMTHSPITPPTIVWTSTGTIEQSTQPLHAVSSEKVSVQTQSTPYVNSVAVSASPTHENSVSSGSSTSSPYSSASLESLDSTISRRNAITSWLWDLTTSLPTTTWPSTSLSEALSSGHSGVSNPSSTTTEFPLFSAASTSAAKQRNPETETHGPQNTAASTLNTDASSVTGLSETPVGASISSEVPLPMAITSRSDVSGLTSESTANPSLGTASSAGTKLTRTISLPTSESLVSFRMNKDPWTVSIPLGSHPTTNTETSIPVNSAGPPGLSTVASDVIDTPSDGAESIPTVSFSPSPDTEVTTISHFPEKTTHSFRTISSLTHELTSRVTPIPGDWMSSAMSTKPTGASPSITLGERRTITSAAPTTSPIVLTASFTETSTVSLDNETTVKTSDILDARKTNELPSDSSSSSDLINTSIASSTMDVTKTASISPTSISGMTASSSPSLFSSDRPQVPTSTTETNTATSPSVSSNTYSLDGGSNVGGTPSTLPPFTITHPVETSSALLAWSRPVRTFSTMVSTDTASGENPTSSNSVVTSVPAPGTWTSVGSTTDLPAMGFLKTSPAGEAHSLLASTIEPATAFTPHLSAAVVTGSSATSEASLLTTSESKAIHSSPQTPTTPTSGANWETSATPESLLVVTETSDTTLTSKILVTDTILFSTVSTPPSKFPSTGTLSGASFPTLLPDTPAIPLTATEPTSSLATSFDSTPLVTIASDSLGTVPETTLTMSETSNGDALVLKTVSNPDRSIPGITIQGVTESPLHPSSTSPSKIVAPRNTTYEGSITVALSTLPAGTTGSLVFSQSSENSETTALVDSSAGLERASVMPLTTGSQGMASSGGIRSGSTHSTGTKTFSSLPLTMNPGEVTAMSEITTNRLTATQSTAPKGIPVKPTSAESGLLTPVSASSSPSKAFASLTTAPPTWGIPQSTLTFEFSEVPSLDTKSASLPTPGQSLNTIPDSDASTASSSLSKSPEKNPRARMMTSTKAISASSFQSTGFTETPEGSASPSMAGHEPRVPTSGTGDPRYASESMSYPDPSKASSAMTSTSLASKLTTLFSTGQAARSGSSSSPISLSTEKETSFLSPTASTSRKTSLFLGPSMARQPNILVHLQTSALTLSPTSTLNMSQEEPPELTSSQTIAEEEGTTAETQTLTFTPSETPTSLLPVSSPTEPTARRKSSPETWASSISVPAKTSLVETTDGTLVTTIKMSSQAAQGNSTWPAPAEETGSSPAGTSPGSPEMSTTLKIMSSKEPSISPEIRSTVRNSPWKTPETTVPMETTVEPVTLQSTALGSGSTSISHLPTGTTSPTKSPTENMLATERVSLSPSPPEAWTNLYSGTPGGTRQSLATMSSVSLESPTARSITGTGQQSSPELVSKTTGMEFSMWHGSTGGTTGDTHVSLSTSSNILEDPVTSPNSVSSLTDKSKHKTETWVSTTAIPSTVLNNKIMAAEQQTSRSVDEAYSSTSSWSDQTSGSDITLGASPDVTNTLYITSTAQTTSLVSLPSGDQGITSLTNPSGGKTSSASSVTSPSIGLETLRANVSAVKSDIAPTAGHLSQTSSPAEVSILDVTTAPTPGISTTITTMGTNSISTTTPNPEVGMSTMDSTPATERRTTSTEHPSTWSSTAASDSWTVTDMTSNLKVARSPGTISTMHTTSFLASSTELDSMSTPHGRITVIGTSLVTPSSDASAVKTETSTSERTLSPSDTTASTPISTFSRVQRMSISVPDILSTSWTPSSTEAEDVPVSMVSTDHASTKTDPNTPLSTFLFDSLSTLDWDTGRSLSSATATTSAPQGATTPQELTLETMISPATSQLPFSIGHITSAVTPAAMARSSGVTFSRPDPTSKKAEQTSTQLPTTTSAHPGQVPRSAATTLDVIPHTAKTPDATFQRQGQTALTTEARATSDSWNEKEKSTPSAPWITEMMNSVSEDTIKEVTSSSSVLRTLNTLDINLESGTTSSPSWKSSPYERIAPSESTTDKEAIHPSTNTVETTGWVTSSEHASHSTIPAHSASSKLTSPVVTTSTREQAIVSMSTTTWPESTRARTEPNSFLTIELRDVSPYMDTSSTTQTSIISSPGSTAITKGPRTEITSSKRISSSFLAQSMRSSDSPSEAITRLSNFPAMTESGGMILAMQTSPPGATSLSAPTLDTSATASWTGTPLATTQRFTYSEKTTLFSKGPEDTSQPSPPSVEETSSSSSLVPIHATTSPSNILLTSQGHSPSSTPPVTSVFLSETSGLGKTTDMSRISLEPGTSLPPNLSSTAGEALSTYEASRDTKAIHHSADTAVTNMEATSSEYSPIPGHTKPSKATSPLVTSHIMGDITSSTSVFGSSETTEIETVSSVNQGLQERSTSQVASSATETSTVITHVSSGDATTHVTKTQATFSSGTSISSPHQFITSTNTFTDVSTNPSTSLIMTESSGVTITTQTGPTGAATQGPYLLDTSTMPYLTETPLAVTPDFMQSEKTTLISKGPKDVSWTSPPSVAETSYPSSLTPFLVTTIPPATSTLQGQHTSSPVSATSVLTSGLVKTTDMLNTSMEPVTNSPQNLNNPSNEILATLAATTDIETIHPSINKAVTNMGTASSAHVLHSTLPVSSEPSTATSPMVPASSMGDALASISIPGSETTDIEGEPTSSLTAGRKENSTLQEMNSTTESNIILSNVSVGAITEATKMEVPSFDATFIPTPAQSTKFPDIFSVASSRLSNSPPMTISTHMTTTQTGSSGATSKIPLALDTSTLETSAGTPSVVTEGFAHSKITTAMNNDVKDVSQTNPPFQDEASSPSSQAPVLVTTLPSSVAFTPQWHSTSSPVSMSSVLTSSLVKTAGKVDTSLETVTSSPQSMSNTLDDISVTSAATTDIETTHPSINTVVTNVGTTGSAFESHSTVSAYPEPSKVTSPNVTTSTMEDTTISRSIPKSSKTTRTETETTSSLTPKLRETSISQEITSSTETSTVPYKELTGATTEVSRTDVTSSSSTSFPGPDQSTVSLDISTETNTRLSTSPIMTESAEITITTQTGPHGATSQDTFTMDPSNTTPQAGIHSAMTHGFSQLDVTTLMSRIPQDVSWTSPPSVDKTSSPSSFLSSPAMTTPSLISSTLPEDKLSSPMTSLLTSGLVKITDILRTRLEPVTSSLPNFSSTSDKILATSKDSKDTKEIFPSINTEETNVKANNSGHESHSPALADSETPKATTQMVITTTVGDPAPSTSMPVHGSSETTNIKREPTYFLTPRLRETSTSQESSFPTDTSFLLSKVPTGTITEVSSTGVNSSSKISTPDHDKSTVPPDTFTGEIPRVFTSSIKTKSAEMTITTQASPPESASHSTLPLDTSTTLSQGGTHSTVTQGFPYSEVTTLMGMGPGNVSWMTTPPVEETSSVSSLMSSPAMTSPSPVSSTSPQSIPSSPLPVTALPTSVLVTTTDVLGTTSPESVTSSPPNLSSITHERPATYKDTAHTEAAMHHSTNTAVTNVGTSGSGHKSQSSVLADSETSKATPLMSTTSTLGDTSVSTSTPNISQTNQIQTEPTASLSPRLRESSTSEKTSSTTETNTAFSYVPTGAITQASRTEISSSRTSISDLDRPTIAPDISTGMITRLFTSPIMTKSAEMTVTTQTTTPGATSQGILPWDTSTTLFQGGTHSTVSQGFPHSEITTLRSRTPGDVSWMTTPPVEETSSGFSLMSPSMTSPSPVSSTSPESIPSSPLPVTALLTSVLVTTTNVLGTTSPEPVTSSPPNLSSPTQERLTTYKDTAHTEAMHASMHTNTAVANVGTSISGHESQSSVPADSHTSKATSPMGITFAMGDTSVSTSTPAFFETRIQTESTSSLIPGLRDTRTSEEINTVTETSTVLSEVPTTTTTEVSRTEVITSSRTTISGPDHSKMSPYISTETITRLSTFPFVTGSTEMAITNQTGPIGTISQATLTLDTSSTASWEGTHSPVTQRFPHSEETTTMSRSTKGVSWQSPPSVEETSSPSSPVPLPAITSHSSLYSAVSGSSPTSALPVTSLLTSGRRKTIDMLDTHSELVTSSLPSASSFSGEILTSEASTNTETIHFSENTAETNMGTTNSMHKLHSSVSIHSQPSGHTPPKVTGSMMEDAIVSTSTPGSPETKNVDRDSTSPLTPELKEDSTALVMNSTTESNTVFSSVSLDAATEVSRAEVTYYDPTFMPASAQSTKSPDISPEASSSHSNSPPLTISTHKTIATQTGPSGVTSLGQLTLDTSTIATSAGTPSARTQDFVDSETTSVMNNDLNDVLKTSPFSAEEANSLSSQAPLLVTTSPSPVTSTLQEHSTSSLVSVTSVPTPTLAKITDMDTNLEPVTRSPQNLRNTLATSEATTDTHTMHPSINTAVANVGTTSSPNEFYFTVSPDSDPYKATSAVVITSTSGDSIVSTSMPRSSAMKKIESETTFSLIFRLRETSTSQKIGSSSDTSTVFDKAFTAATTEVSRTELTSSSRTSIQGTEKPTMSPDTSTRSVTMLSTFAGLTKSEERTIATQTGPHRATSQGTLTWDTSITTSQAGTHSAMTHGFSQLDLSTLTSRVPEYISGTSPPSVEKTSSSSSLLSLPAITSPSPVPTTLPESRPSSPVHLTSLPTSGLVKTTDMLASVASLPPNLGSTSHKIPTTSEDIKDTEKMYPSTNIAVTNVGTTTSEKESYSSVPAYSEPPKVTSPMVTSFNIRDTIVSTSMPGSSEITRIEMESTFSLAHGLKGTSTSQDPIVSTEKSAVLHKLTTGATETSRTEVASSRRTSIPGPDHSTESPDISTEVIPSLPISLGITESSNMTIITRTGPPLGSTSQGTFTLDTPTTSSRAGTHSMATQEFPHSEMTTVMNKDPEILSWTIPPSIEKTSFSSSLMPSPAMTSPPVSSTLPKTIHTTPSPMTSLLTPSLVMTTDTLGTSPEPTTSSPPNLSSTSHEILTTDEDTTAIEAMHPSTSTAATNVETTSSGHGSQSSVLADSEKTKATAPMDTTSTMGHTTVSTSMSVSSETTKIKRESTYSLTPGLRETSISQNASFSTDTSIVLSEVPTGTTAEVSRTEVTSSGRTSIPGPSQSTVLPEISTRTMTRLFASPTMTESAEMTIPTQTGPSGSTSQDTLTLDTSTTKSQAKTHSTLTQRFPHSEMTTLMSRGPGDMSWQSSPSLENPSSLPSLLSLPATTSPPPISSTLPVTISSSPLPVTSLLTSSPVTTTDMLHTSPELVTSSPPKLSHTSDERLTTGKDTTNTEAVHPSTNTAASNVEIPSSGHESPSSALADSETSKATSPMFITSTQEDTTVAISTPHFLETSRIQKESISSLSPKLRETGSSVETSSAIETSAVLSEVSIGATTEISRTEVTSSSRTSISGSAESTMLPEISTTRKIIKFPTSPILAESSEMTIKTQTSPPGSTSESTFTLDTSTTPSLVITHSTMTQRLPHSEITTLVSRGAGDVPRPSSLPVEETSPPSSQLSLSAMISPSPVSSTLPASSHSSSASVTSLLTPGQVKTTEVLDASAEPETSSPPSLSSTSVEILATSEVTTDTEKIHPFSNTAVTKVGTSSSGHESPSSVLPDSETTKATSAMGTISIMGDTSVSTLTPALSNTRKIQSEPASSLTTRLRETSTSEETSLATEANTVLSKVSTGATTEVSRTEAISFSRTSMSGPEQSTMSQDISIGTIPRISASSVLTESAKMTITTQTGPSESTLESTLNLNTATTPSWVETHSIVIQGFPHPEMTTSMGRGPGGVSWPSPPFVKETSPPSSPLSLPAVTSPHPVSTTFLAHIPPSPLPVTSLLTSGPATTTDILGTSTEPGTSSSSSLSTTSHERLTTYKDTAHTEAVHPSTNTGGTNVATTSSGYKSQSSVLADSSPMCTTSTMGDTSVLTSTPAFLETRRIQTELASSLTPGLRESSGSEGTSSGTKMSTVLSKVPTGATTEISKEDVTSIPGPAQSTISPDISTRTVSWFSTSPVMTESAEITMNTHTSPLGATTQGTSTLDTSSTTSLTMTHSTISQGFSHSQMSTLMRRGPEDVSWMSPPLLEKTRPSFSLMSSPATTSPSPVSSTLPESISSSPLPVTSLLTSGLAKTTDMLHKSSEPVTNSPANLSSTSVEILATSEVTTDTEKTHPSSNRTVTDVGTSSSGHESTSFVLADSQTSKVTSPMVITSTMEDTSVSTSTPGFFETSRIQTEPTSSLTLGLRKTSSSEGTSLATEMSTVLSGVPTGATAEVSRTEVTSSSRTSISGFAQLTVSPETSTETITRLPTSSIMTESAEMMIKTQTDPPGSTPESTHTVDISTTPNWVETHSTVTQRFSHSEMTTLVSRSPGDMLWPSQSSVEETSSASSLLSLPATTSPSPVSSTLVEDFPSASLPVTSLLNPGLVITTDRMGISREPGTSSTSNLSSTSHERLTTLEDTVDTEDMQPSTHTAVTNVRTSISGHESQSSVLSDSETPKATSPMGTTYTMGETSVSISTSDFFETSRIQIEPTSSLTSGLRETSSSERISSATEGSTVLSEVPSGATTEVSRTEVISSRGTSMSGPDQFTISPDISTEAITRLSTSPIMTESAESAITIETGSPGATSEGTLTLDTSTTTFWSGTHSTASPGFSHSEMTTLMSRTPGDVPWPSLPSVEEASSVSSSLSSPAMTSTSFFSTLPESISSSPHPVTALLTLGPVKTTDMLRTSSEPETSSPPNLSSTSAEILATSEVTKDREKIHPSSNTPVVNVGTVIYKHLSPSSVLADLVTTKPTSPMATTSTLGNTSVSTSTPAFPETMMTQPTSSLTSGLREISTSQETSSATERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLVSLSAVTSPSPLYSTPSESSHSSPLRVTSLFTPVMMKTTDMLDTSLEPVTTSPPSMNITSDESLATSKATMETEAIQLSENTAVTQMGTISARQEFYSSYPGLPEPSKVTSPVVTSSTIKDIVSTTIPASSEITRIEMESTSTLTPTPRETSTSQEIHSATKPSTVPYKALTSATIEDSMTQVMSSSRGPSPDQSTMSQDISTEVITRLSTSPIKTESTEMTITTQTGSPGATSRGTLTLDTSTTFMSGTHSTASQGFSHSQMTALMSRTPGDVPWLSHPSVEEASSASFSLSSPVMTSSSPVSSTLPDSIHSSSLPVTSLLTSGLVKTTELLGTSSEPETSSPPNLSSTSAEILAITEVTTDTEKLEMTNVVTSGYTHESPSSVLADSVTTKATSSMGITYPTGDTNVLTSTPAFSDTSRIQTKSKLSLTPGLMETSISEETSSATEKSTVLSSVPTGATTEVSRTEAISSSRTSIPGPAQSTMSSDTSMETITRISTPLTRKESTDMAITPKTGPSGATSQGTFTLDSSSTASWPGTHSATTQRFPQSVVTTPMSRGPEDVSWPSPLSVEKNSPPSSLVSSSSVTSPSPLYSTPSGSSHSSPVPVTSLFTSIMMKATDMLDASLEPETTSAPNMNITSDESLAASKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMPSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTSSEPKTSSSPNLSSTSVEIPATSEIMTDTEKIHPSSNTAVAKVRTSSSVHESHSSVLADSETTITIPSMGITSAVDDTTVFTSNPAFSETRRIPTEPTFSLTPGFRETSTSEETTSITETSAVLYGVPTSATTEVSMTEIMSSNRIHIPDSDQSTMSPDIITEVITRLSSSSMMSESTQMTITTQKSSPGATAQSTLTLATTTAPLARTHSTVPPRFLHSEMTTLMSRSPENPSWKSSLFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGFRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSSPILDTRMTESVELGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASMQMASTIPTEMMITTPYVFPDVPETTSSLATSLGAETSTALPRTTPSVFNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSATAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTSSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTTGPLLVPFTLNFTITNLQYEENMGHPGSRKFNITESVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMRRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPMTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMQHLLSPLFQRSSLGARYTGCRVIALRSVKNGAETRVDLLCTYLQPLSGPGLPIKQVFHELSQQTHGITRLGPYSLDKDSLYLNGYNEPGPDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGVITCLICGVLVTTRRRKKEGEYNVQQQCPGYYQSHLDLEDLQ

SEQ ID NO: 107 - protein, 267 aa, Homo sapiens
MMSSKPTSHAEVNETIPNPYPPSSFMAPGFQQPLGSINLENQAQGAQRAQPYGITSPGIFASSQPGQGNIQMINPSVGTAVMNFKEEAKALGVIQIMVGLMHIGFGIVLCLISFSFREVLGFASTAVIGGYPFWGGLSFIISGSLSVSASKELSRCLVKGSLGMNIVSSILAFIGVILLLVDMCINGVAGQDYWAVLSGKGISATLMIFSLLEFFVACATAHFANQANTTTNMSVLVIPNMYESNPVTPASSSAPPRCNNYSANAPK

SEQ ID NO: 108 - protein, 535 aa, Homo sapiens
MLGPCMLLLLLLLGLRLQLSLGIIPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAHPGRSVVPALLPLLAGTLLLLETATAP

SEQ ID NO: 109 - protein, 520 aa, Homo sapiens
MEFHNGGHVSGIGGFLVSLTSRMKPHTLAVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALRGAFGTLNQLGIVIGILVAQIFGLELILGSEELWPVLLGFTILPAILQSAALPCCPESPRFLLINRKKEENATRILQRLWGTQDVSQDIQEMKDESARMSQEKQVTVLELFRVSSYRQPIIISIVLQLSQQLSGINAVFYYSTGIFKDAGVQQPIYATISAGVVNTIFTLLSLFLVERAGRRTLHMIGLGGMAFCSTLMTVSLLLKNHYNGMSFVCIGAILVFVACFEIGPGPIPWFIVAELFSQGPRPAAMAVAGCSNWTSNFLVGLLFPSAAYYLGAYVFIIFTGFLITFLAFTFFKVPETRGRTFEDITRAFEGQAHGADRSGKDGVMGMNSIEPAKETTTNV

SEQ ID NO: 110 - protein, 221 aa, Homo sapiens
MLTLEDKDMKGFSWAIVPALTSLGYLIILVVSIFPFWVRLTNEESHEVFFSGLFENCFNAKCWKPRPLSIYIILGRVFLLSAVFLAFVTTFIMMPFASEFFPRTWKQNFVLACISFFTGACAFLALVLHALEIKALRMKLGPLQFSVLWPYYVLGFGIFLFIVAGTICLIQEMVCPCWHLLSTSQSMEEDHGSLYLDNLESLGGEPSSVQKETQVTAETVI

SEQ ID NO: 111 - protein, 538 aa, Homo sapiens
MGLLLLVLILTPSLAAYRHPDFPLLEKAQQLLQSTGSPYSTNCWLCTSSSTETPGTAYPASPREWTSIEAELHISYRWDPNLKGLMRPANSLLSTVKQDFPDIRQKPPIFGPIFTNINLMGIAPICVMAKRKNGTNVGTLPSTVCNVTFTVDSNQQTYQTYTHNQFRHQPRFPKPPNITFPQGTLLDKSSRFCQGRPSSCSTRNFWFRPADYNQCLQISNLSSTAEWVLLDQTRNSLFWENKTKGANQSQTPCVQVLAGMTIATSYLGISAVSEFFGTSLTPLFHFHISTCLKTQGAFYICGQSIHQCLPSNWTGTCTIGYVTPDIFIAPGNLSLPIPIYGNSPLPRVRRAIHFIPLLAGLGILAGTGTGIAGITKASLTYSQLSKEIANNIDTMAKALTTMQEQIDSLAAVVLQNRRGLDMLTAAQGGICLALDEKCCFWVNQSGKVQDNIRQLLNQASSLRERATQGWLNWEGTWKWFSWVLPLTGPLVSLLLLLLFGPCLLNLITQFVSSRLQAIKLQTNLSAGRHPRNIQESPF

SEQ ID NO: 112 - protein, 1017 aa, Homo sapiens
MVFSVRQCGHVGRTEEVLLTFKIFLVIICLHVVLVTSLEEDTDNSSLSPPPAKLSVVSFAPSSNGTPEVETTSLNDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 113 - protein, 775 aa, Homo sapiens
MEPPYSLTAHYDEFQEVKYVSRCGAGGARGASLPPGFPLGAARSATGARSGLPRWNRREVCLLSGLVFAAGLCAILAAMLALKYLGPVAAGGGACPEGCPERKAFARAARFLAANLDASIDPCQDFYSFACGGWLRRHAIPDDKLTYGTIAAIGEQNEERLRRLLARPGGGPGGAAQRKVRAFFRSCLDMREIERLGPRPMLEVIEDCGGWDLGGAEERPGVAARWDLNRLLYKAQGVYSAAALFSLTVSLDDRNSSRYVIRIDQDGLTLPERTLYLAQDEDSEKILAAYRVFMERVLSLLGADAVEQKAQEILQVEQQLANITVSEHDDLRRDVSSMYNKVTLGQLQKITPHLRWKWLLDQIFQEDFSEEEEVVLLATDYMQQVSQLIRSTPHRVLHNYLVWRVVVVLSEHLSPPFREALHELAQEMEGSDKPQELARVCLGQANRHFGMALGALFVHEHFSAASKAKVQQLVEDIKYILGQRLEELDWMDAETRAAARAKLQYMMVMVGYPDFLLKPDAVDKEYEFEVHEKTYFKNILNSIRFSIQLSVKKIRQEVDKSTWLLPPQALNAYYLPNKNQMVFPAGILQPTLYDPDFPQSLNYGGIGTIIGHELTHGYDDWGGQYDRSGNLLHWWTEASYSRFLRKAECIVRLYDNFTVYNQRVNGKHTLGENIADMGGLKLAYHAYQKWVREHGPEHPLPRLKYTHDQLFFIAFAQNWCIKRRSQSIYLQVLTDKHAPEHYRVLGSVSQFEEFGRAFHCPKDSPMNPAHKCSVW

SEQ ID NO: 114 - protein, 529 aa, Homo sapiens
MGPSCPVFLSFTKLSLWWLLLTPAGGEEAKRPPPRAPGDPLSSPSPTALPQGGSHTETEDRLFKHLFRGYNRWARPVPNTSDVVIVRFGLSIAQLIDVDEKNQMMTTNVWLKQEWSDYKLRWNPTDFGNITSLRVPSEMIWIPDIVLYNNADGEFAVTHMTKAHLFSTGTVHWVPPAIYKSSCSIDVTFFPFDQQNCKMKFGSWTYDKAKIDLEQMEQTVDLKDYWESGEWAIVNATGTYNSKKYDCCAEIYPDVTYAFVIRRLPLFYTINLIIPCLLISCLTVLVFYLPSDCGEKITLCISVLLSLTVFLLLITEIIPSTSLVIPLIGEYLLFTMIFVTLSIVITVFVLNVHHRSPSTHTMPHWVRGALLGCVPRWLLMNRPPPPVELCHPLRLKLSPSYHWLESNVDAEEREVVVEEEDRWACAGHVAPSVGTLCSHGHLHSGASGPKAEALLQEGELLLSPHMQKALEGVHYIADHLRSEDADSSVKEDWKYVAMVIDRIFLWLFIIVCFLGTIGLFLPPFLAGMI

SEQ ID NO: 115 - protein, 537 aa, Homo sapiens
MPHLMERMVGSGLLWLALVSCILTQASAVQRGYGNPIEASSYGLDLDCGAPGTPEAHVCFDPCQNYTLLDEPFRSTENSAGSQGCDKNMSGWYRFVGEGGVRMSETCVQVHRCQTDAPMWLNGTHPALGDGITNHTACAHWSGNCCFWKTEVLVKACPGGYHVYRLEGTPWCNLRYCTVPRDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 116 - protein, 426 aa, Homo sapiens
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYLETPKPYISSSNLNPREAMEAVRLICDPETLDASYLWWMNGQSLPVTHRLQLSKTNRTLYLFGVTKYIAGPYECEIRNPVSASRSDPVTLNLLPKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLFIPQITRNHSGLYACSVHNSATGKEISKSMTVKVSGPCHGDLTESQS

SEQ ID NO: 117 - protein, 328 aa, Homo sapiens
MEKSIWLLACLAWVLPTGSFVRTKIDTTENLLNTEVHSSPAQRWSMQVPPEVSAEAGDAAVLPCTFTHPHRHYDGPLTAIWRAGEPYAGPQVFRCAAARGSELCQTALSLHGRFRLLGNPRRNDLSLRVERLALADDRRYFCRVEFAGDVHDRYESRHGVRLHVTAAPRIVNISVLPSPAHAFRALCTAEGEPPPALAWSGPALGNSLAAVRSPREGHGHLVTAELPALTHDGRYTCTAANSLGRSEASVYLFRFHGASGASTVALLLGALGFKALLLLGVLAARAARRRPEHLDTPDTPPRSQAQESNYENLSQMNPRSPPATMCSP

SEQ ID NO: 118 - protein, 620 aa, Homo sapiens
MSKSKCSVGLMSSVVAPAKEPNAVGPKEVELILVKEQNGVQLTSSTLTNPRQSPVEAQDRETWGKKIDFLLSVIGFAVDLANVWRFPYLCYKNGGGAFLVPYLLFMVIAGMPLFYMELALGQFNREGAAGVWKICPILKGVGFTVILISLYVGFFYNVIIAWALHYLFSSFTTELPWIHCNNSWNSPNCSDAHPGDSSGDSSGLNDTFGTTPAAEYFERGVLHLHQSHGIDDLGPPRWQLTACLVLVIVLLYFSLWKGVKTSGKVVWITATMPYVVLTALLLRGVTLPGAIDGIRAYLSVDFYRLCEASVWIDAATQVCFSLGVGFGVLIAFSSYNKFTNNCYRDAIVTTSINSLTSFSSGFVVFSFLGYMAQKHSVPIGDVAKDGPGLIFIIYPEAIATLPLSSAWAVVFFIMLLTLGIDSAMGGMESVITGLIDEFQLLHRHRELFTLFIVLATFLLSLFCVTNGGIYVFTLLDHFAAGTSILFGVLIEAIGVAWFYGVGQFSDDIQQMTGQRPSLYWRLCWKLVSPCFLLFVVVVSIVTFRPPHYGAYIFPDWANALGWVIATSSMAMVPIYAAYKFCSLPGSFREKLAYAIAPEKDRELVDRGEVRQFTLRHWLKV

SEQ ID NO: 119 - protein, 398 aa, Homo sapiens
MHTVATSGPNASWGAPANASGCPGCGANASDGPVPSPRAVDAWLVPLFFAALMLLGLVGNSLVIYVICRHKPMRTVTNFYIANLAATDVTFLLCCVPFTALLYPLPGWVLGDFMCKFVNYIQQVSVQATCATLTAMSVDRWYVTVFPLRALHRRTPRLALAVSLSIWVGSAAVSAPVLALHRLSPGPRAYCSEAFPSRALERAFALYNLLALYLLPLLATCACYAAMLRHLGRVAVRPAPADSALQGQVLAERAGAVRAKVSRLVAAVVLLFAACWGPIQLFLVLQALGPAGSWHPRSYAAYALKTWAHCMSYSNSALNPLLYAFLGSHFRQAFRRVCPCAPRRPRRPRRPGPSDPAAPHAELLRLGSHPAPARAQKPGSSGLAARGLCVLGEDNAPL

SEQ ID NO: 120 - protein, 431 aa, Homo sapiens
MQALNITPEQFSRLLRDHNLTREQFIALYRLRPLVYTPELPGRAKLALVLTGVLIFALALFGNALVFYVVTRSKAMRTVTNIFICSLALSDLLITFFCIPVTMLQNISDNWLGGAFICKMVPFVQSTAVVTEILTMTCIAVERHQGLVHPFKMKWQYTNRRAFTMLGVVWLVAVIVGSPMWHVQQLEIKYDFLYEKEHICCLEEWTSPVHQKIYTTFILVILFLLPLMVMLILYSKIGYELWIKKRVGDGSVLRTIHGKEMSKIARKKKRAVIMMVTVVALFAVCWAPFHVVHMMIEYSNFEKEYDDVTIKMIFAIVQIIGFSNSICNPIVYAFMNENFKKNVLSAVCYCIVNKTFSPAQRHGNSGITMMRKKAKFSLRENPVEETKGEAFSDGNIEVKLCEQTEEKKKLKRHLALFRSELAENSPLDSGH

SEQ ID NO: 121 - protein, 335 aa, Homo sapiens
MESSFSFGVILAVLASLIIATNTLVAVAVLLLIHKNDGVSLCFTLNLAVADTLIGVAISGLLTDQLSSPSRPTQKTLCSLRMAFVTSSAAASVLTVMLITFDRYLAIKQPFRYLKIMSGFVAGACIAGLWLVSYLIGFLPLGIPMFQQTAYKGQCSFFAVFHPHFVLTLSCVGFFPAMLLFVFFYCDMLKIASMHSQQIRKMEHAGAMAGGYRSPRTPSDFKALRTVSVLIGSFALSWTPFLITGIVQVACQECHLYLVLERYLWLLGVGNSLLNPLIYAYWQKEVRLQLYHMALGVKKVLTSFLLFLSARNCGPERPRESSCHIVTISSSEFDG

SEQ ID NO: 122 - protein, 220 aa, Homo sapiens
MASAGMQILGVVLTLLGWVNGLVSCALPMWKVTAFIGNSIVVAQVVWEGLWMSCVVQSTGQMQCKVYDSLLALPQDLQAARALCVIALLVALFGLLVYLAGAKCTTCVEEKDSKARLVLTSGIVFVISGVLTLIPVCWTAHAIIRDFYNPLVAEAQKRELGASLYLGWAASGLLLLGGGLLCCTCPSGGSQGPSHYMARYSTSAPAISRGPSEYPTKNYV

SEQ ID NO: 123 - protein, 21 aa, Homo sapiens
MALPVTALLLPLALLLHAARP

SEQ ID NO: 124 - protein, 15 aa, Homo sapiens
GGGGSGGGGSGGGGS

SEQ ID NO: 125 - protein, 45 aa, Artificial Sequence
  Synthesized
TTTPAPRPPTPAPTIASQPLSLRPEACRPAAGGAVHTRGLDFACD

SEQ ID NO: 126 - protein, 23 aa, Artificial Sequence
  Synthesized
YIWAPLAGTCGVLLLSLVITLYC

SEQ ID NO: 127 - protein, 42 aa, Artificial Sequence; identical to SEQ ID NO: 3
  Synthesized

SEQ ID NO: 128 - protein, 112 aa, Artificial Sequence; identical to SEQ ID NO: 4
  Synthesized

SEQ ID NO: 129 - protein, 485 aa, Artificial Sequence
  Synthesized
MALPVTALLLPLALLLHAARPQIVLTQSPAIMSASLGERVTMTCTASSVVISTYLHWYQQKPGSSPKLWIYSTSNLASGVPVRFSGSGSGTSYSLTISSMEAEDAATYYCHQYHRSPWTFGGGTKLEIKGGGGSGGGGSGGGGSEVQLQQSGPELVKPGGSMKISCKASGYSFTGYTMNWVKQSHGKNLEWIGLINPYNGGISYNQKFKDKATLTMDKSSSTAYMELLSLTSEDSAIYFCARDYRYEGFDYWGQGTLVTVSATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 130 - protein, 241 aa, Artificial Sequence
  Synthesized
QIVLTQSPAIMSASLGERVTMTCTASSVVISTYLHWYQQKPGSSPKLWIYSTSNLASGVPVRFSGSGSGTSYSLTISSMEAEDAATYYCHQYHRSPWTFGGGTKLEIKGGGGSGGGGSGGGGSEVQLQQSGPELVKPGGSMKISCKASGYSFTGYTMNWVKQSHGKNLEWIGLINPYNGGISYNQKFKDKATLTMDKSSSTAYMELLSLTSEDSAIYFCARDYRYEGFDYWGQGTLVTVSA

SEQ ID NO: 131 - protein, 108 aa, Artificial Sequence
  Synthesized
QIVLTQSPAIMSASLGERVTMTCTASSVVISTYLHWYQQKPGSSPKLWIYSTSNLASGVPVRFSGSGSGTSYSLTISSMEAEDAATYYCHQYHRSPWTFGGGTKLEIK

SEQ ID NO: 132 - protein, 118 aa, Artificial Sequence
  Synthesized
EVQLQQSGPELVKPGGSMKISCKASGYSFTGYTMNWVKQSHGKNLEWIGLINPYNGGISYNQKFKDKATLTMDKSSSTAYMELLSLTSEDSAIYFCARDYRYEGFDYWGQGTLVTVSA

SEQ ID NO: 133 - protein, 488 aa, Artificial Sequence
  Synthesized
MALPVTALLLPLALLLHAARPENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSNTAHMELRSLTSEDSAVYYCARVLFLDFDDPYLMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 134 - protein, 244 aa, Artificial Sequence
  Synthesized
ENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSNTAHMELRSLTSEDSAVYYCARVLFLDFDDPYLMDYWGQGTSVTVSS

SEQ ID NO: 135 - protein, 106 aa, Artificial Sequence
  Synthesized
NVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKE

SEQ ID NO: 136 - protein, 123 aa, Artificial Sequence
  Synthesized
EVQLQQSGPELVKPGASVKISCKASGYSFTGYFMNWVKQSHGKSLEWIGRINPYNGDTFYNQKFKGKATLTVDKSSNTAHMELRSLTSEDSAVYYCARVLFLDFDDPYLMDYWGQGTSVTVSS

SEQ ID NO: 137 - protein, 485 aa, Artificial Sequence
  Synthesized
MALPVTALLLPLALLLHAARPDIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIKGGGGSGGGGSGGGGSEVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTLVTVSTTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 138 - protein, 241 aa, Artificial Sequence
  Synthesized
DIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIKGGGGSGGGGSGGGGSEVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTLVTVST

SEQ ID NO: 139 - protein, 107 aa, Artificial Sequence
  Synthesized
DIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIK

SEQ ID NO: 140 - protein, 119 aa, Artificial Sequence
  Synthesized
EVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTLVTVST

SEQ ID NO: 141 - protein, 488 aa, Artificial Sequence
  Synthesized
MALPVTALLLPLALLLHAARPENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSSTAHMELRSLTSEDSAVYYCARVLFLDFDDPYLMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 142 - protein, 244 aa, Artificial Sequence
  Synthesized
ENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSSTAHMELRSLTSEDSAVYYCARVLFLDFDDPYLMDYWGQGTSVTVSS

SEQ ID NO: 143 - protein, 106 aa, Artificial Sequence
  Synthesized
ENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELK

SEQ ID NO: 144 - protein, 123 aa, Artificial Sequence
  Synthesized
EVQLQQSGPELVKPGASVKISCKASGYSFTGYFMNWVKQSHGKSLEWIGRINPYNGDTFYNQKFKGKATLTVDKSSSTAHMELRSLTSEDSAVYYCARVLFLDFDDPYLMDYWGQGTSVTVSS

SEQ ID NO: 145 - protein, 482 aa, Artificial Sequence
  Synthesized
MALPVTALLLPLALLLHAARPSSELTQDPAVSVALGQTVRITCRGDSLRKYYASWYQQKPRQAPQLVIYHKNNRASGIPDRFSGSISGNTASLTITGAQAEDEAAYFCNSRDTSGNYLVFGGGTKVTVLGGGGGSGGGGSGGGGSQLQLQESGPGLVKPSETLSLTCAVSGASISNWWSWVRQPPGKGLEWIGEVHHSGVTTYKPSLKSRVTISVDNSKNQLSLKLTSVTAADTAVYYCAREFADDAFDIWGRGTMVTVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 146 - protein, 238 aa, Artificial Sequence
  Synthesized
SSELTQDPAVSVALGQTVRITCRGDSLRKYYASWYQQKPRQAPQLVIYHKNNRASGIPDRFSGSISGNTASLTITGAQAEDEAAYFCNSRDTSGNYLVFGGGTKVTVLGGGGGSGGGGSGGGGSQLQLQESGPGLVKPSETLSLTCAVSGASISNWWSWVRQPPGKGLEWIGEVHHSGVTTYKPSLKSRVTISVDNSKNQLSLKLTSVTAADTAVYYCAREFADDAFDIWGRGTMVTV

SEQ ID NO: 147 - protein, 109 aa, Artificial Sequence
  Synthesized
SSELTQDPAVSVALGQTVRITCRGDSLRKYYASWYQQKPRQAPQLVIYHKNNRASGIPDRFSGSISGNTASLTITGAQAEDEAAYFCNSRDTSGNYLVFGGGTKVTVLG

SEQ ID NO: 148 - protein, 114 aa, Artificial Sequence
  Synthesized
QLQLQESGPGLVKPSETLSLTCAVSGASISNWWSWVRQPPGKGLEWIGEVHHSGVTTYKPSLKSRVTISVDNSKNQLSLKLTSVTAADTAVYYCAREFADDAFDIWGRGTMVTV

SEQ ID NO: 149 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWMGTIDPETGGTAYNQKFKGRVTITADKSTSTAYMELSSLRSEDTAVYYCTSFYYTYSNYDVGFAYWGQGTLVTVSS

SEQ ID NO: 150 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWIGTIDPETGGTAYNQKFKGRATLTADRSTSTAYMELSSLRSEDTAVYYCTSFYYTYSNYDVGFAYWGQGTLVTVSS

SEQ ID NO: 151 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGQGLEWIGTIDPETGGTAYNQKFKGKATLTADRSTSTAYMELSSLRSEDTAVYYCTSFYYTYSNYDVGFAYWGQGTLVTVSS

SEQ ID NO: 152 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGHGLEWIGTIDPETGGTAYNQKFKGKATLTADRSTSTAYMELSSLTSEDTAVYYCTSFYYTYSNYDVGFAYWGQGTLVTVSS

SEQ ID NO: 153 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWMGTIDPETGGTAYNQKFKGRVTITADKSTSTAYMELSSLRSEDTAVYYCTSFYYTYSNYDVGFAYWGQGTLVTVSS

SEQ ID NO: 154 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWIGTIDPETGGTAYNQKFKGRATLTADRSTSTAYMELSSLRSEDTAVYYCTSFYYTYSNYDVGFAYWGQGTLVTVSS

SEQ ID NO: 155 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGQGLEWIGTIDPETGGTAYNQKFKGKATLTADRSTSTAYMELSSLRSEDTAVYYCTSFYYTYSNYDVGFAYWGQGTLVTVSS

SEQ ID NO: 156 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGHGLEWIGTIDPETGGTAYNQKFKGKATLTADRSTSTAYMELSSLTSEDTAVYYCTSFYYTYSNYDVGFAYWGQGTLVTVSS

SEQ ID NO: 157 - protein, 112 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIK

SEQ ID NO: 158 - protein, 112 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIK

SEQ ID NO: 159 - protein, 123 aa, Artificial Sequence
  Synthesized
EIQLQQSGAEVKKPGSSVKVSCKASGYTFTDYDMHWVRQAPGQGLEWMGTIDPETGGTAYNQKFKGRVTITADKSTSTAYMELSSLRSEDTAVYYCTSFYYTYSNYDVGFAYWGQGTLVTVSS

SEQ ID NO: 160 - protein, 123 aa, Artificial Sequence
  Synthesized
EIQLQQSGAEVKKPGSSVKVSCKASGYTFTDYDMHWVRQAPGQGLEWIGTIDPETGGTAYNQKFKGRATLTADRSTSTAYMELSSLRSEDTAVYYCTSFYYTYSNYDVGFAYWGQGTLVTVSS

SEQ ID NO: 161 - protein, 123 aa, Artificial Sequence
  Synthesized
EIQLQQSGAEVKKPGSSVKVSCKASGYTFTDYDMHWVKQAPGQGLEWIGTIDPETGGTAYNQKFKGKATLTADRSTSTAYMELSSLRSEDTAVYYCTSFYYTYSNYDVGFAYWGQGTLVTVSS

SEQ ID NO: 162 - protein, 123 aa, Artificial Sequence
  Synthesized
EIQLQQSGAEVKKPGSSVKVSCKASGYTFTDYDMHWVKQAPGHGLEWIGTIDPETGGTAYNQKFKGKATLTADRSTSTAYMELSSLTSEDTAVYYCTSFYYTYSNYDVGFAYWGQGTLVTVSS

SEQ ID NO: 163 - protein, 482 aa, Artificial Sequence
  Synthesized
MALPVTALLLPLALLLHAARPDIQMTQSPSSLSASVGDRVTITCKASDLIHNWLAWYQQKPGKAPKLLIYGATSLETGVPSRFSGSGSGTDFTLTISSLQPEDFATYYCQQYWTTPFTFGQGTKVEIKGGGGSGGGGSGGGGSEVQLVESGGGLVQPGGSLRLSCAASGYSITNDYAWNWVRQAPGKGLEWVGYISYSGYTTYNPSLKSRFTISRDTSKNTLYLQMNSLRAEDTAVYYCARWTSGLDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 164 - protein, 238 aa, Artificial Sequence
  Synthesized
DIQMTQSPSSLSASVGDRVTITCKASDLIHNWLAWYQQKPGKAPKLLIYGATSLETGVPSRFSGSGSGTDFTLTISSLQPEDFATYYCQQYWTTPFTFGQGTKVEIKGGGGSGGGGSGGGGSEVQLVESGGGLVQPGGSLRLSCAASGYSITNDYAWNWVRQAPGKGLEWVGYISYSGYTTYNPSLKSRFTISRDTSKNTLYLQMNSLRAEDTAVYYCARWTSGLDYWGQGTLVTVSS

SEQ ID NO: 165 - protein, 107 aa, Artificial Sequence
  Synthesized
DIQMTQSPSSLSASVGDRVTITCKASDLIHNWLAWYQQKPGKAPKLLIYGATSLETGVPSRFSGSGSGTDFTLTISSLQPEDFATYYCQQYWTTPFTFGQGTKVEIK

SEQ ID NO: 166 - protein, 116 aa, Artificial Sequence
  Synthesized
EVQLVESGGGLVQPGGSLRLSCAASGYSITNDYAWNWVRQAPGKGLEWVGYISYSGYTTYNPSLKSRFTISRDTSKNTLYLQMNSLRAEDTAVYYCARWTSGLDYWGQGTLVTVSS

SEQ ID NO: 167 - protein, 482 aa, Artificial Sequence
  Synthesized
MALPVTALLLPLALLLHAARPDIQMTQSSSFLSVSLGGRVTITCKASDLIHNWLAWYQQKPGNAPRLLISGATSLETGVPSRFSGSGSGNDYTLSIASLQTEDAATYYCQQYWTTPFTFGSGTKVEIKGGGGSGGGGSGGGGSDVQLQESGPGLVNPSQSLSLTCTVTGYSITNDYAWNWIRQFPGNKLEWMGYINYSGYTTYNPSLKSRISITRDTSKNQFFLHLNSVTTEDTATYYCARWDGGLTYWGQGTLVTVSATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 168 - protein, 238 aa, Artificial Sequence
  Synthesized
DIQMTQSSSFLSVSLGGRVTITCKASDLIHNWLAWYQQKPGNAPRLLISGATSLETGVPSRFSGSGSGNDYTLSIASLQTEDAATYYCQQYWTTPFTFGSGTKVEIKGGGGSGGGGSGGGGSDVQLQESGPGLVNPSQSLSLTCTVTGYSITNDYAWNWIRQFPGNKLEWMGYINYSGYTTYNPSLKSRISITRDTSKNQFFLHLNSVTTEDTATYYCARWDGGLTYWGQGTLVTVSA

SEQ ID NO: 169 - protein, 107 aa, Artificial Sequence
  Synthesized
DIQMTQSSSFLSVSLGGRVTITCKASDLIHNWLAWYQQKPGNAPRLLISGATSLETGVPSRFSGSGSGNDYTLSIASLQTEDAATYYCQQYWTTPFTFGSGTKVEIK

SEQ ID NO: 170 - protein, 116 aa, Artificial Sequence
  Synthesized
DVQLQESGPGLVNPSQSLSLTCTVTGYSITNDYAWNWIRQFPGNKLEWMGYINYSGYTTYNPSLKSRISITRDTSKNQFFLHLNSVTTEDTATYYCARWDGGLTYWGQGTLVTVSA

SEQ ID NO: 171 - protein, 298 aa, Artificial Sequence
  Synthesized
MALPVTALLLPLALLLHAARPGTSLSPPPESSGSPQQPGLSAPHSRQIPAPQGAVLVQREKDLPNYNWNSFGLRFTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 172 - protein, 54 aa, Artificial Sequence
  Synthesized
GTSLSPPPESSGSPQQPGLSAPHSRQIPAPQGAVLVQREKDLPNYNWNSFGLRF

SEQ ID NO: 173 - protein, 19 aa, Artificial Sequence
  Synthesized
GTTGCTCCAGGCCACAGCA

SEQ ID NO: 174 - protein, 7 aa, Artificial Sequence
  Synthesized
QSGDLTR

SEQ ID NO: 175 - protein, 7 aa, Artificial Sequence
  Synthesized
QWGTRYR

SEQ ID NO: 176 - protein, 7 aa, Artificial Sequence
  Synthesized
ERGTLAR

SEQ ID NO: 177 - protein, 7 aa, Artificial Sequence
  Synthesized
RSDNLRE

SEQ ID NO: 178 - protein, 7 aa, Artificial Sequence
  Synthesized
QSGDLTR

SEQ ID NO: 179 - protein, 7 aa, Artificial Sequence
  Synthesized
TSGALTR

SEQ ID NO: 180 - protein, 12 aa, Artificial Sequence
  Synthesized
GACTTTGCATGT

SEQ ID NO: 181 - protein, 7 aa, Artificial Sequence
  Synthesized
WRSSLAS

SEQ ID NO: 182 - protein, 7 aa, Artificial Sequence
  Synthesized
QSGSLTR

SEQ ID NO: 183 - protein, 7 aa, Artificial Sequence
  Synthesized
HKWVLRQ

SEQ ID NO: 184 - protein, 7 aa, Artificial Sequence
  Synthesized
DRSNLTR

SEQ ID NO: 185 - protein, 293 aa, Artificial Sequence
  Synthesized
MQRISSLIHLSLFWAGVMSAIELVPEHQTVPVSIGVPATLRCSMKGEAIGNYYINWYRKTQGNTITFIYREKDIYGPGFKDNFQGDIDIAKNLAVLKILAPSERDEGSYYCACDTMGHPRGKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFLTRDC

SEQ ID NO: 186 - protein, 315 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEAQQELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 187 - protein, 292 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDTLGMGGEYTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 188 - protein, 313 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEWELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 189 - protein, 288 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDTLVSTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 190 - protein, 314 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEVGELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 191 - protein, 291 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDTVAHGGGTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 192 - protein, 313 aa, Artificial Sequence; identical to SEQ ID NO: 188
  Synthesized

SEQ ID NO: 193 - protein, 291 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDNLSTGGYTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 194 - protein, 316 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEVYQGELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 195 - protein, 291 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDILGEKPYTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 196 - DNA, 339 bp, Artificial Sequence; identical to SEQ ID NO: 41
  Synthesized

SEQ ID NO: 197 - protein, 276 aa, Artificial Sequence
  Synthesized
MKKHLTTFLVILWLYFYRGNGKNQVEQSPQSLIILEGKNCTLQCNYTVSPFSNLRWYKQDTGRGPVSLTIMTFSENTKSNGRYTATLDADTKQSSLHITASQLSDSASYICVVSDRGSTLGRLYFGRGTQLTVWPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 198 - protein, 313 aa, Artificial Sequence
  Synthesized
MTIRLLCYVGFYFLGAGLMEADIYQTPRYLVIGTGKKITLECSQTMGHDKMYWYQQDPGMELHLIHYSYGVNSTEKGDLSSESTVSRIRTEHFPLTLESARPSHTSQYLCASSGLRDRGLYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 199 - protein, 267 aa, Artificial Sequence
  Synthesized
MWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVKDSNYQLIWGAGTKLIIKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 200 - protein, 138 aa, Artificial Sequence
  Synthesized
MAVLVLLLCLLIFPSCVLSQVQLKESGPGLVQPSQTLSLTCTVSGSSLTSNSVSWIRQPPGKGLEWMGVIWSNGDADYNSAIKSRLSISRDTSKSQVFLKMNSLQTEDTAMYFCASPYYGYYFPFDYWGQGVMVTVSS

SEQ ID NO: 201 - DNA, 3533 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 202 - protein, 488 aa, Artificial Sequence
  Synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 203 - protein, 486 aa, Artificial Sequence
  Synthesized
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 204 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 205 - protein, 485 aa, Artificial Sequence
  Synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 206 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 207 - protein, 483 aa, Artificial Sequence
  Synthesized
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 208 - DNA, 3515 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 209 - DNA, 3533 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 210 - protein, 490 aa, Artificial Sequence
  Synthesized
MALPVTALLLPLALLLHAARPDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 211 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 212 - protein, 487 aa, Artificial Sequence
  Synthesized
MALPVTALLLPLALLLHAARPDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 213 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 214 - DNA, 3515 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 215 - DNA, 3533 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 216 - protein, 486 aa, Artificial Sequence
  Synthesized
MALPVTALLLPLALLLHAARPDIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIKGGGGSGGGGSGGGGSEVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 217 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 218 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 219 - protein, 483 aa, Artificial Sequence
  Synthesized
MALPVTALLLPLALLLHAARPDIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIKGGGGSGGGGSGGGGSEVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 220 - DNA, 3515 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 221 - protein, 3533 aa, Artificial Sequence
  Synthesized
ATGGCCTTACCAGTGACCGCCTTGCTCCTGCCGCTGGCCTTGCTGCTCCACGCCGCCAGGCCGGACATCGTGATGACCCAGTCCCCCTCCAGCCTGACAGTGACAGCCGGCGAGAAGGTGACAATGATCTGTAAGTCCAGCCAGAGCCTGCTGAACAGCGGCGACCAGAAGAACTACCTGACCTGGTACCAGCAGAAGCCTGGCCAGCCCCCCAAGCTGCTGATCTTCTGGGCCAGCACAAGGGAGAGCGGCGTGCCCGACAGATTCACAGGCAGCGGCAGCGGCACCGACTTCACACTGACCATTTCCTCCGTGCAGGCCGAGGACCTCGCCGTGTACTACTGCCAGAACGACTACTCCTACCCCCTGACATTCGGCGCCGGCACCAAACTGGAGCTGAAGGGTGGCGGTGGCTCGGGCGGTGGTGGGTCGGGTGGCGGCGGATCTCAGGTGCAGCTCCAGCAGTCCGATGCCGAGCTGGTGAAGCCCGGAAGCAGCGTCAAGATCAGCTGTAAGGCCTCCGGCTACACCTTCACAGACCACGCCATCCACTGGGTGAAGCAGAAGCCCGAGCAGGGCCTGGAGTGGATCGGCCACTTTAGCCCCGGAAACACCGACATCAAGTACAACGACAAGTTCAAGGGCAAGGCCACCCTGACCGTGGACAGGAGCAGCAGCACCGCCTACATGCAGCTGAACAGCCTGACAAGCGAGGACAGCGCCGTGTACTTCTGCAAGACCTCCACCTTCTTCTTCGACTACTGGGGCCAGGGAACCACCCTGACAGTGTCCAGCACCACGACGCCAGCGCCGCGACCACCAACACCGGCGCCCACCATCGCGTCGCAGCCCCTGTCCCTGCGCCCAGAGGCGTGCCGGCCAGCGGCGGGGGGCGCAGTGCACACGAGGGGGCTGGACTTCGCCTGTGATATCTACATCTGGGCGCCCTTGGCCGGGACTTGTGGGGTCCTTCTCCTGTCACTGGTTATCACCCTTTACTGCAAACGGGGCAGAAAGAAACTCCTGTATATATTCAAACAACCATTTATGAGACCAGTACAAACTACTCAAGAGGAAGATGGCTGTAGCTGCCGATTTCCAGAAGAAGAAGAAGGAGGATGTGAACTGAGAGTGAAGTTCAGCAGGAGCGCAGACGCCCCCGCGTACAAGCAGGGCCAGAACCAGCTCTATAACGAGCTCAATCTAGGACGAAGAGAGGAGTACGATGTTTTGGACAAGAGGCGTGGCCGGGACCCTGAGATGGGGGGAAAGCCGAGAAGGAAGAACCCTCAGGAAGGCCTGTACAATGAACTGCAGAAAGATAAGATGGCGGAGGCCTACAGTGAGATTGGGATGAAAGGCGAGCGCCGGAGGGGCAAGGGGCACGATGGCCTTTACCAGGGTCTCAGTACAGCCACCAAGGACACCTACGACGCCCTTCACATGCAGGCCCTGCCCCCTCGCTAATCTAGAGGCGCGCCCCTCTCCCTCCCCCCCCCCTAACGTTACTGGCCGAAGCCGCTTGGAATAAGGCCGGTGTGCGTTTGTCTATATGTTATTTTCCACCATATTGCCGTCTTTTGGCAATGTGAGGGCCCGGAAACCTGGCCCTGTCTTCTTGACGAGCATTCCTAGGGGTCTTTCCCCTCTCGCCAAAGGAATGCAAGGTCTGTTGAATGTCGTGAAGGAAGCAGTTCCTCTGGAAGCTTCTTGAAGACAAACAACGTCTGTAGCGACCCTTTGCAGGCAGCGGAACCCCCCACCTGGCGACAGGTGCCTCTGCGGCCAAAAGCCACGTGTATAAGATACACCTGCAAAGGCGGCACAACCCCAGTGCCACGTTGTGAGTTGGATAGTTGTGGAAAGAGTCAAATGGCTCTCCTCAAGCGTATTCAACAAGGGGCTGAAGGATGCCCAGAAGGTACCCCATTGTATGGGATCTGATCTGGGGCCTCGGTACACATGCTTTACATGTGTTTAGTCGAGGTTAAAAAAACGTCTAGGCCCCCCGAACCACGGGGACGTGGTTTTCCTTTGAAAAACACGATGATAATATGGCCACAACCCATATGATGGCCTTACCAGTGACCGCCTTGCTCCTGCCGCTGGCCTTGCTGCTCCACGCCGCCAGGCCGGATATCCAGATGACCCAGAGCCCGAGCAGCCTGAGCGCGAGCGTGGGTGATCGCGTGACCATTACCTGCAGGGCAAGTCAGGACATTAGTAAATATTTAAATTGGTATCAGCAGAAACCGGGTAAAGCGCCGAAACTGTTAATTTATCATACATCAAGATTACACTCAGGCGTGCCGTCGCGTTTTAGCGGCTCGGGTTCGGGCACCGATTTTACCCTGACCATCTCGAGCTTGCAGCCGGAGGACTTCGCCACCTACTATTGCCAACAGGGTAATACGCTTCCGTACACGTTCGGTCAGGGCACCAAAGTGGAGATCAAAGGTGGCGGTGGCTCGGGCGGTGGTGGGTCGGGTGGCGGCGGATCTGAGGTGCAGCTGGTGGAGTCTGGGGGAGGCTTGGTACAGCCTGGGGGGTCCCTGAGACTCTCCTGTGCAGCCTCTGGAGTGTCCCTGCCTGATTATGGCGTGTCCTGGGTCCGCCAGGCTCCAGGGAAGGGGCTGGAGTGGGTTTCAGTGATCTGGGGCAGCGAGACAACCTACTACAACAGCGCCCTGAAGTCCCGATTCACCATCTCCAGAGACAATGCCAAGAACTCACTGTATCTGCAAATGAACAGCCTGAGAGCCGAGGACACGGCTGTGTATTACTGTGCGAAGCACTACTACTACGGCGGCAGCTACGCTATGGACTACTGGGGCCAAGGAACCCTGGTCACCGTGTCCTCAACCACGACGCCAGCGCCGCGACCACCAACACCGGCGCCCACCATCGCGTCGCAGCCCCTGTCCCTGCGCCCAGAGGCGTGCCGGCCAGCGGCGGGGGGCGCAGTGCACACGAGGGGGCTGGACTTCGCCTGTGATATCTACATCTGGGCGCCCTTGGCCGGGACTTGTGGGGTCCTTCTCCTGTCACTGGTTATCACCCTTTACTGCAAACGGGGCAGAAAGAAACTCCTGTATATATTCAAACAACCATTTATGAGACCAGTACAAACTACTCAAGAGGAAGATGGCTGTAGCTGCCGATTTCCAGAAGAAGAAGAAGGAGGATGTGAACTGAGAGTGAAGTTCAGCAGGAGCGCAGACGCCCCCGCGTACAAGCAGGGCCAGAACCAGCTCTATAACGAGCTCAATCTAGGACGAAGAGAGGAGTACGATGTTTTGGACAAGAGGCGTGGCCGGGACCCTGAGATGGGGGGAAAGCCGAGAAGGAAGAACCCTCAGGAAGGCCTGTACAATGAACTGCAGAAAGATAAGATGGCGGAGGCCTACAGTGAGATTGGGATGAAAGGCGAGCGCCGGAGGGGCAAGGGGCACGATGGCCTTTACCAGGGTCTCAGTACAGCCACCAAGGACACCTACGACGCCCTTCACATGCAGGCCCTGCCCCCTCGCTAA

SEQ ID NO: 222 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 223 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 224 - DNA, 3515 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 225 - DNA, 3545 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 226 - protein, 490 aa, Artificial Sequence
  Synthesized
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 227 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 228 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 229 - protein, 487 aa, Artificial Sequence
  Synthesized
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 230 - DNA, 3527 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 231 - DNA, 3545 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 232 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 233 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 234 - DNA, 3527 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 235 - DNA, 3665 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 236 - protein, 530 aa, Artificial Sequence
  Synthesized
MALPVTALLLPLALLLHAARPMGWSCIILFLVATATGVHSNIVLTQSPASLAVSLGQRATISCRASESVDSYGNSFMHWYQQKPGQPPKLLIYLASNLESGVPARFSGSGSRTDFTLTIDPVEADDVATYYCQQNNGDPYTFGGGTKLEIIRGGGGSGGGGSGGGGSMGWSCIILFLVATATGVHSEVQLVESGGGLMQPKGSLKLSCAASGFTFKTYALNWVRQAPGTGLEWVARIRSKSNNYTTYYADSVKDRFTISRDDSQNMLYLQMNNLKTEDTAMYYCVRPQSGTSFAYWGQGTLVTVSAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 237 - DNA, 3656 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 238 - DNA, 3656 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 239 - protein, 527 aa, Artificial Sequence
  Synthesized
MALPVTALLLPLALLLHAARPMGWSCIILFLVATATGVHSNIVLTQSPASLAVSLGQRATISCRASESVDSYGNSFMHWYQQKPGQPPKLLIYLASNLESGVPARFSGSGSRTDFTLTIDPVEADDVATYYCQQNNGDPYTFGGGTKLEIIRGGGGSGGGGSGGGGSMGWSCIILFLVATATGVHSEVQLVESGGGLMQPKGSLKLSCAASGFTFKTYALNWVRQAPGTGLEWVARIRSKSNNYTTYYADSVKDRFTISRDDSQNMLYLQMNNLKTEDTAMYYCVRPQSGTSFAYWGQGTLVTVSAATTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 240 - DNA, 3665 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 241 - DNA, 3656 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 242 - DNA, 3656 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 243 - DNA, 3647 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 244 - DNA, 3518 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 245 - protein, 482 aa, Artificial Sequence
  Synthesized
MALPVTALLLPLALLLHAARPEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKGGGGSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 246 - DNA, 3509 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 247 - DNA, 3509 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 248 - protein, 479 aa, Artificial Sequence
  Synthesized
MALPVTALLLPLALLLHAARPEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKGGGGSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 249 - DNA, 3500 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 250 - DNA, 3518 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 251 - DNA, 3509 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 252 - DNA, 3509 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 253 - DNA, 3500 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 254 - DNA, 3545 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 255 - protein, 490 aa, Artificial Sequence
  Synthesized
MALPVTALLLPLALLLHAARPEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIKGGGGSGGGGSGGGGSQVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 256 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 257 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 258 - protein, 487 aa, Artificial Sequence
  Synthesized
MALPVTALLLPLALLLHAARPEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIKGGGGSGGGGSGGGGSQVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 259 - DNA, 3527 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 260 - DNA, 3545 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 261 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 262 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 263 - DNA, 3527 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 264 - protein, 505 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSS

SEQ ID NO: 265 - protein, 505 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 266 - protein, 69 aa, Artificial Sequence; identical to SEQ ID NO: 30
  Synthesized

SEQ ID NO: 267 - protein, 66 aa, Artificial Sequence; identical to SEQ ID NO: 29
  Synthesized

SEQ ID NO: 268 - protein, 69 aa, Artificial Sequence; identical to SEQ ID NO: 2
  Synthesized

SEQ ID NO: 269 - protein, 72 aa, Artificial Sequence; identical to SEQ ID NO: 31
  Synthesized

SEQ ID NO: 270 - protein, 728 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 271 - protein, 725 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 272 - protein, 728 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSAKPTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 273 - protein, 731 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 274 - protein, 728 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 275 - protein, 725 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 276 - protein, 728 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSAKPTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 277 - protein, 731 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 278 - protein, 5 aa, Artificial Sequence
  Synthesized
GGGGS

SEQ ID NO: 279 - DNA, 1470 bp, Artificial Sequence
  Synthesized
atggccttaccagtgaccgccttgctcctgccgctggccttgctgctccacgccgccaggccgcagtccgtgctgacccagccaccttccgtgtctgccgctccaggccagaaggtgacaatcagctgctccggcagctcctctgacatcggaagcaactacgtgtcctggtaccagcagttcccaggcaccgcccccaagctgctgatctacgacaacaacaagaggcctagcgccatcccagatagattttctggcagcaagtccggaacctccgccacactgggcatcaccggactgcagacaggcgacgaggctgattactactgcggcacatgggattccaggctgggaatcgccgtgttcggaggaggaacccagctgacagtgctgggcggaggaggaggaagcggaggaggaggatccggaggaggaggatctgaggtgcagctggtgcagtctggcgccgaggtgaagaagcctggacagtctctgaagatcagctgtaaggcttccggctactctctgaccgacaactggatcggatgggtgcggcagaagccaggcaagggactggagtggatgggcatcatctacccaggagactctgatacacgctactctcccagctttcagggccaggtgaccatctccgccgataagtctatcaacacagcttacctgcagtggagctccctgaaggccagcgacaccgctatctactactgcgtgggcctggattggaactacaacccactgaggtactggggacctggaaccctggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 280 - protein, 196 aa, Artificial Sequence; identical to SEQ ID NO: 97
  Synthesized

SEQ ID NO: 281 - protein, 196 aa, Artificial Sequence; identical to SEQ ID NO: 98
  Synthesized

SEQ ID NO: 282 - protein, 196 aa, Flavobacterium ameridies; identical to SEQ ID NO: 96

SEQ ID NO: 283 - DNA, 24 bp, Homo sapiens
ggctcctgctgcatcgtagctgct

SEQ ID NO: 284 - protein, 7 aa, Artificial Sequence
  Synthesized
QRASLTR

SEQ ID NO: 285 - DNA, 24 bp, Homo sapiens
agctgccccttcgcggacgtggcc

SEQ ID NO: 286 - protein, 7 aa, Artificial Sequence
  Synthesized
DRSNLTR

SEQ ID NO: 287 - protein, 7 aa, Artificial Sequence
  Synthesized
RSDALSR

SEQ ID NO: 288 - protein, 7 aa, Artificial Sequence
  Synthesized
ERGTLAR

SEQ ID NO: 289 - DNA, 24 bp, Homo sapiens
tgccgcccctactgtggagatgga

SEQ ID NO: 290 - protein, 7 aa, Artificial Sequence
  Synthesized
TSGNLVR

SEQ ID NO: 291 - protein, 7 aa, Artificial Sequence
  Synthesized
QSGHLAR

SEQ ID NO: 292 - protein, 7 aa, Artificial Sequence
  Synthesized
RSDDLQR

SEQ ID NO: 293 - DNA, 24 bp, Homo sapiens
accatcaacagactggaagtgggg

SEQ ID NO: 294 - protein, 7 aa, Artificial Sequence
  Synthesized
QTVNLDR

SEQ ID NO: 295 - protein, 7 aa, Artificial Sequence
  Synthesized
KKDHLHR

SEQ ID NO: 296 - DNA, 24 bp, Homo sapiens
agctgccccttcgcggacgtggcc

SEQ ID NO: 297 - protein, 7 aa, Artificial Sequence
  Synthesized
HHNSLTR

SEQ ID NO: 298 - protein, 7 aa, Artificial Sequence
  Synthesized
MKHHLDA

SEQ ID NO: 299 - protein, 7 aa, Artificial Sequence
  Synthesized
DPSNLRR

SEQ ID NO: 300 - protein, 7 aa, Artificial Sequence
  Synthesized
RREVLEN

SEQ ID NO: 301 - protein, 7 aa, Artificial Sequence
  Synthesized
QSGSLTR

SEQ ID NO: 302 - protein, 7 aa, Artificial Sequence
  Synthesized
DRSDLTR

SEQ ID NO: 303 - protein, 7 aa, Artificial Sequence
  Synthesized
QSSALTR

SEQ ID NO: 304 - DNA, 24 bp, Homo sapiens
tgcggcaacctacatgatggggaa

SEQ ID NO: 305 - protein, 7 aa, Artificial Sequence
  Synthesized
QRSNLVR

SEQ ID NO: 306 - protein, 7 aa, Artificial Sequence
  Synthesized
RSDHLTR

SEQ ID NO: 307 - protein, 7 aa, Artificial Sequence
  Synthesized
TSANLSR

SEQ ID NO: 308 - protein, 7 aa, Artificial Sequence
  Synthesized
QSSDLTR

SEQ ID NO: 309 - protein, 7 aa, Artificial Sequence
  Synthesized
RSDNLAR

SEQ ID NO: 310 - protein, 7 aa, Artificial Sequence
  Synthesized
QSGHLQR

SEQ ID NO: 311 - DNA, 23 bp, Homo sapiens
agcctctccagccaggggctgag

SEQ ID NO: 312 - protein, 7 aa, Artificial Sequence
  Synthesized
RSDHLSR

SEQ ID NO: 313 - protein, 7 aa, Artificial Sequence
  Synthesized
RSDHLAR

SEQ ID NO: 314 - protein, 7 aa, Artificial Sequence
  Synthesized
QSGDLTR

SEQ ID NO: 315 - protein, 7 aa, Artificial Sequence
  Synthesized
RSDDLTR

SEQ ID NO: 316 - protein, 7 aa, Artificial Sequence
  Synthesized
RSDALTR

SEQ ID NO: 317 - protein, 7 aa, Artificial Sequence
  Synthesized
TSGHLVR

SEQ ID NO: 318 - protein, 7 aa, Artificial Sequence
  Synthesized
QSSDLQR

SEQ ID NO: 319 - DNA, 24 bp, Artificial Sequence
  Synthesized
ccctgccgcctgcctgctggtgtg

SEQ ID NO: 320 - protein, 7 aa, Artificial Sequence
  Synthesized
GGTALRM

SEQ ID NO: 321 - protein, 7 aa, Artificial Sequence
  Synthesized
QRSSLVR

SEQ ID NO: 322 - protein, 7 aa, Artificial Sequence
  Synthesized
QRNNLGR

SEQ ID NO: 323 - protein, 7 aa, Artificial Sequence
  Synthesized
RKRNLIM

SEQ ID NO: 324 - protein, 7 aa, Artificial Sequence
  Synthesized
VRHNLTR

SEQ ID NO: 325 - protein, 7 aa, Artificial Sequence
  Synthesized
RGDKLGP

SEQ ID NO: 326 - DNA, 24 bp, Homo sapiens
gtttacttcctttggggggattgc

SEQ ID NO: 327 - protein, 7 aa, Artificial Sequence
  Synthesized
SRFTLGR

SEQ ID NO: 328 - protein, 7 aa, Artificial Sequence
  Synthesized
RREHLVR

SEQ ID NO: 329 - protein, 7 aa, Artificial Sequence
  Synthesized
QTATLKR

SEQ ID NO: 330 - protein, 7 aa, Artificial sequence
  Synthesized
KHSNLAR

SEQ ID NO: 331 - protein, 7 aa, Artificial Sequence
  Synthesized
QSTTLKR

SEQ ID NO: 332 - protein, 7 aa, Artificial Sequence
  Synthesized
RADGLQL

SEQ ID NO: 333 - DNA, 24 bp, Artificial Sequence
  Synthesized
cacccctgcaccgactcggcagag

SEQ ID NO: 334 - protein, 7 aa, Artificial Sequence
  Synthesized
TRQKLET

SEQ ID NO: 335 - protein, 7 aa, Artificial Sequence
  Synthesized
RQDNLGR

SEQ ID NO: 336 - protein, 7 aa, Artificial Sequence
  Synthesized
QQHGLRH

SEQ ID NO: 337 - protein, 7 aa, Artificial Sequence
  Synthesized
TKKILTV

SEQ ID NO: 338 - protein, 7 aa, Artificial Sequence
  Synthesized
HKSSLTR

SEQ ID NO: 339 - protein, 7 aa, Artificial Sequence
  Synthesized
RSDHLSL

SEQ ID NO: 340 - DNA, 23 bp, Homo sapiens
accctcacaacctttgggttgtc

SEQ ID NO: 341 - protein, 7 aa, Artificial Sequence
  Synthesized
RKHHLGR

SEQ ID NO: 342 - protein, 7 aa, Artificial Sequence
  Synthesized
VSNSLAR

SEQ ID NO: 343 - protein, 7 aa, Artificial Sequence
  Synthesized
RTSSLKR

SEQ ID NO: 344 - protein, 7 aa, Artificial Sequence
  Synthesized
QRSDLTR

SEQ ID NO: 345 - protein, 7 aa, Artificial Sequence
  Synthesized
RSDGLRG

SEQ ID NO: 346 - DNA, 24 bp, Homo sapiens
ccccccagcaccctttcggctgtg

SEQ ID NO: 347 - protein, 7 aa, Artificial Sequence
  Synthesized
DSPTLRR

SEQ ID NO: 348 - protein, 7 aa, Artificial Sequence
  Synthesized
QSAHLKR

SEQ ID NO: 349 - protein, 7 aa, Artificial Sequence
  Synthesized
QDVSLVR

SEQ ID NO: 350 - protein, 7 aa, Artificial Sequence
  Synthesized
MKNTLTR

SEQ ID NO: 351 - protein, 7 aa, Artificial Sequence
  Synthesized
QSGTLTR

SEQ ID NO: 352 - DNA, 24 bp, Homo sapiens
ggctcctgctgcatcgtagctgct

SEQ ID NO: 353 - protein, 7 aa, Artificial Sequence
  Synthesized
TKQILGR

SEQ ID NO: 354 - protein, 7 aa, Artificial Sequence
  synthesized
RTEHLAR

SEQ ID NO: 355 - protein, 7 aa, Artificial Sequence
  Synthesized
KRRDLDR

SEQ ID NO: 356 - protein, 237 aa, Artificial Sequence
  Synthesized
DIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSS

SEQ ID NO: 357 - protein, 7 aa, Artificial Sequence
  Synthesized
RTSSLKR

SEQ ID NO: 358 - protein, 7 aa, Artificial Sequence
  Synthesized
QRSDLTR

SEQ ID NO: 359 - protein, 7 aa, Artificial Sequence
  Synthesized
RSDHLSL

SEQ ID NO: 360 - DNA, 25 bp, Homo sapiens
cacagcccaagatagttaagtgggg

SEQ ID NO: 361 - protein, 7 aa, Artificial Sequence
  Synthesized
KKDHLHR

SEQ ID NO: 362 - protein, 7 aa, Artificial Sequence
  Synthesized
RREVLEN

SEQ ID NO: 363 - protein, 7 aa, Artificial Sequence
  Synthesized
QRGNLNM

SEQ ID NO: 364 - protein, 7 aa, Artificial Sequence
  Synthesized
VPSKLKR

SEQ ID NO: 365 - protein, 7 aa, Artificial Sequence
  Synthesized
EAHHLSR

SEQ ID NO: 366 - protein, 7 aa, Artificial Sequence
  Synthesized
QDGNLTR

SEQ ID NO: 367 - protein, 7 aa, Artificial Sequence
  Synthesized
TSTLLNR

SEQ ID NO: 368 - protein, 7 aa, Artificial Sequence
  Synthesized
QQTNLTR

SEQ ID NO: 369 - protein, 7 aa, Artificial Sequence
  Synthesized
VGNSLTR

SEQ ID NO: 370 - protein, 7 aa, Artificial Sequence
  Synthesized
QSGSLTR

SEQ ID NO: 371 - protein, 7 aa, Artificial Sequence
  Synthesized
TSGNLVR

SEQ ID NO: 372 - protein, 7 aa, Artificial Sequence
  Synthesized
QSGDLTR

SEQ ID NO: 373 - protein, 7 aa, Artificial Sequence
  Synthesized
RSDNLAR

SEQ ID NO: 374 - protein, 7 aa, Artificial Sequence
  Synthesized
DRSDLTR

SEQ ID NO: 375 - protein, 7 aa, Artificial Sequence
  Synthesized
QSGHLQR

SEQ ID NO: 376 - protein, 7 aa, Artificial Sequence
  Synthesized
DRSHLTR

SEQ ID NO: 377 - protein, 7 aa, Artificial Sequence
  Synthesized
RSDALSR

SEQ ID NO: 378 - protein, 7 aa, Artificial Sequence
  Synthesized
QSSDLQR

SEQ ID NO: 379 - protein, 7 aa, Artificial Sequence
  Synthesized
ERGTLAR

SEQ ID NO: 380 - protein, 7 aa, Artificial Sequence
  Synthesized
RSDDLQR

SEQ ID NO: 381 - protein, 7 aa, Artificial Sequence
  Synthesized
RSDALTR

SEQ ID NO: 382 - protein, 7 aa, Artificial Sequence
  Synthesized
RSDHLAR

SEQ ID NO: 383 - protein, 7 aa, Artificial Sequence
  Synthesized
QSGDLTR

SEQ ID NO: 384 - protein, 7 aa, Artificial Sequence
  Synthesized
QSGHLQR

SEQ ID NO: 385 - protein, 7 aa, Artificial Sequence
  Synthesized
QSSDLTR

SEQ ID NO: 386 - protein, 7 aa, Artificial Sequence
  Synthesized
RSDNLRE

SEQ ID NO: 387 - protein, 7 aa, Artificial Sequence
  Synthesized
RSDHLSR

SEQ ID NO: 388 - protein, 7 aa, Artificial Sequence
  Synthesized
QSGHLAR

SEQ ID NO: 389 - protein, 7 aa, Artificial Sequence
  Synthesized
DRSDLTR

SEQ ID NO: 390 - protein, 7 aa, Artificial Sequence
  Synthesized
QSGNLAR

SEQ ID NO: 391 - protein, 7 aa, Artificial Sequence
  Synthesized
DRSHLTR

SEQ ID NO: 392 - protein, 7 aa, Artificial Sequence
  Synthesized
QSGDLTR

SEQ ID NO: 393 - protein, 7 aa, Artificial Sequence
  Synthesized
QSGHLQR

SEQ ID NO: 394 - protein, 7 aa, Artificial Sequence
  Synthesized
RSHILTN

SEQ ID NO: 395 - protein, 7 aa, Artificial Sequence
  Synthesized
QSTTLKR

SEQ ID NO: 396 - protein, 7 aa, Artificial Sequence
  Synthesized
DGGHLTR

SEQ ID NO: 397 - protein, 7 aa, Artificial Sequence
  Synthesized
RQMNLDR

SEQ ID NO: 398 - protein, 7 aa, Artificial Sequence
  Synthesized
RQDNLGR

SEQ ID NO: 399 - protein, 7 aa, Artificial Sequence
  Synthesized
DKSVLAR

SEQ ID NO: 400 - DNA, 23 bp, Homo sapiens
gccaccttcccccagctgaagtc

SEQ ID NO: 401 - DNA, 24 bp, Homo sapiens
tgcatctgcgacgtgggagccgag

SEQ ID NO: 402 - DNA, 23 bp, Homo sapiens
gcccacagccactcgtggcggcc

SEQ ID NO: 403 - DNA, 23 bp, Homo sapiens
ccctgctccctccgggggctgct

SEQ ID NO: 404 - DNA, 23 bp, Homo sapiens
tccggcttctccatggagcaggc

SEQ ID NO: 405 - DNA, 24 bp, Homo sapiens
cactgcgcccacgaggccgaggag

SEQ ID NO: 406 - protein, 7 aa, Artificial Sequence
  Synthesized
HKWVLRQ

SEQ ID NO: 407 - protein, 7 aa, Artificial Sequence
  Synthesized
DRSNLTR

SEQ ID NO: 408 - DNA, 19 bp, Homo sapiens
gttgctccaggccacagca

SEQ ID NO: 409 - protein, 7 aa, Artificial Sequence
  Synthesized
QSGDLTR

SEQ ID NO: 410 - protein, 7 aa, Artificial Sequence
  Synthesized
QWGTRYR

SEQ ID NO: 411 - protein, 7 aa, Artificial Sequence
  Synthesized
ERGTLAR

SEQ ID NO: 412 - protein, 7 aa, Artificial Sequence
  Synthesized
QSGDLTR

SEQ ID NO: 413 - protein, 7 aa, Artificial Sequence
  Synthesized
TSGALTR

SEQ ID NO: 414 - DNA, 12 bp, Homo sapiens
gactttgcatgt

SEQ ID NO: 415 - protein, 7 aa, Artificial Sequence
  Synthesized
WRSSLAS

SEQ ID NO: 416 - protein, 7 aa, Artificial Sequence
  Synthesized
QSGSLTR

SEQ ID NO: 417 - protein, 9 aa, Artificial Sequence
  Synthesized
TGPGAAARA

SEQ ID NO: 418 - protein, 5 aa, Artificial Sequence
  Synthesized
LRGSQ

SEQ ID NO: 419 - DNA, 18 bp, Homo sapiens
ctccagccaggtccatct

SEQ ID NO: 420 - DNA, 17 bp, Homo sapiens
tctccagccaggtccat

SEQ ID NO: 421 - DNA, 15 bp, Homo sapiens
tcagcaggctgttgt

SEQ ID NO: 422 - DNA, 17 bp, Homo sapiens
tcagcaggctgttgtgt

SEQ ID NO: 423 - DNA, 15 bp, Homo sapiens
ccctggtctcttcat

SEQ ID NO: 424 - DNA, 16 bp, Homo sapiens
aagcctccctggtctt

SEQ ID NO: 425 - DNA, 15 bp, Homo sapiens
aagcctccctggtct

SEQ ID NO: 426 - DNA, 17 bp, Homo sapiens
gctgaccccctgtgcct

SEQ ID NO: 427 - DNA, 16 bp, Homo sapiens
gaccccctgtgcctct

SEQ ID NO: 428 - protein, 21 aa, Artificial Sequence
  Synthesized
MALPVTALLLPLALLLHAARP

SEQ ID NO: 429 - protein, 111 aa, Artificial Sequence
  Synthesized
QSVLTQPPSVSAAPGQKVTISCSGSSSDIGSNYVSWYQQFPGTAPKLLIYDNNKRPSAIPDRFSGSKSGTSATLGITGLQTGDEADYYCGTWDSRLGIAVFGGGTQLTVLG

SEQ ID NO: 430 - protein, 119 aa, Artificial Sequence [sequence omitted]

SEQ ID NO: 431 - protein, 20 aa, Artificial Sequence
  Synthesized
GGGGSGGGGSGGGGSGGGGS

SEQ ID NO: 432 - protein, 120 aa, Artificial Sequence
  Synthesized
EVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSS

SEQ ID NO: 433 - protein, 107 aa, Artificial Sequence; identical to SEQ ID NO: 74
  Synthesized

SEQ ID NO: 434 - protein, 240 aa, Artificial Sequence
  Synthesized
DIVMTQSHKFMSTSIGARVSITCKASQDVRTAVAWYQQKPGQSPKLLIYSASYRYTGVPDRFTGSGSGTDFTFTISSVQAEDLAVYYCQQHYGTPPWTFGGGTKLEIKGGGGSGGGGSGGGGSEVQLVESGGGLVKPGGSLKLSCEASRFTFSSYAMSWVRQTPEKRLEWVAAISGGGRYTYYPDSMKGRFTISRDNAKNFLYLQMSSLRSEDTAMYYCARHYDGYLDYWGQGTTLTVSS

SEQ ID NO: 435 - protein, 238 aa, Artificial Sequence
  Synthesized
DIVMTQSHKFMSTSIGARVSITCKASQDVRTAVAWYQQKPGQSPKWYSASYRYTGVPDRFTGSGSGTDFTFTISSVQAEDLAVYYCQQHYGTPPWTFGGGTKLEIKGGGGSGGGGSGGGGSEVQLVESGGGLVKPGGSLKLSCEASRFTFSSYAMSWVRQTPEKRLEWVAAISGGGRYTYYPDSMKGRFTISRDNAKNFLYLQMSSLRSEDTAMYYCARHYDGYLDYWGQGTTLTVSS

SEQ ID NO: 436 - protein, 244 aa, Artificial Sequence
  Synthesized
EVQLVESGGGLVQPGGSLRLSCAASGFTFSSFGMHWVRQAPGKGLEWVAYISSDSSAIYYADTVKGRFTISRDNAKNSLYLQMNSLRDEDTAVYYCGRGRENIYYGSRLDYWGQGTTVTVSSGGGGSGGGGSGGGGSDIQLTQSPSFLSASVGDRVTITCKASQNVDTNVAWYQQKPGKAPKALIYSASYRYSGVPSRFSGSGSGTDFTLTISSLQPEDFATYYCQQYNNYPFTFGQGTKLEIK

SEQ ID NO: 437 - protein, 113 aa, Artificial Sequence
  Synthesized
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIK

SEQ ID NO: 438 - protein, 118 aa, Artificial Sequence
  Synthesized
QVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSS

SEQ ID NO: 439 - protein, 490 aa, Artificial Sequence
  Synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 440 - protein, 510 aa, Artificial Sequence
  synthesized
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 441 - protein, 510 aa, Artificial Sequence
  synthesized
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELK

SEQ ID NO: 442 - protein, 510 aa, Artificial Sequence
  synthesized
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 443 - protein, 510 aa, Artificial Sequence
  synthesized
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELK

SEQ ID NO: 444 - protein, 510 aa, Artificial Sequence
  synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSS

SEQ ID NO: 445 - protein, 510 aa, Artificial Sequence
  synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIK

SEQ ID NO: 446 - protein, 510 aa, Artificial Sequence
  synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSS

SEQ ID NO: 447 - protein, 510 aa, Artificial Sequence
  synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELK

SEQ ID NO: 448 - protein, 754 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 449 - protein, 754 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 450 - protein, 754 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 451 - protein, 754 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 452 - protein, 754 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 453 - protein, 754 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 454 - protein, 754 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 455 - protein, 754 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 456 - protein, 753 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 457 - protein, 753 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 458 - protein, 753 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 459 - protein, 753 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 460 - protein, 753 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 461 - protein, 753 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 462 - protein, 753 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 463 - protein, 753 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 464 - protein, 242 aa, Artificial Sequence; identical to SEQ ID NO: 5
  synthesized

SEQ ID NO: 465 - protein, 242 aa, Artificial Sequence
  synthesized
EVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSSGGGGSGGGGSGGGGSDIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIK

SEQ ID NO: 466 - protein, 245 aa, Artificial Sequence
  synthesized
QSVLTQPPSVSAAPGQKVTISCSGSSSDIGSNYVSWYQQFPGTAPKLLIYDNNKRPSAIPDRFSGSKSGTSATLGITGLQTGDEADYYCGTWDSRLGIAVFGGGTQLTVLGGGGGSGGGGSGGGGSEVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSS

SEQ ID NO: 467 - protein, 245 aa, Artificial Sequence
  synthesized
EVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSGGGGGSGGGGSGGGGSQSVLTQPPSVSAAPGQKVTISCSGSSSDIGSNYVSWYQQFPGTAPKLLIYDNNKRPSAIPDRFSGSKSGTSATLGITGLQTGDEADYYCGTWDSRLGIAVFGGGTQLTVL

SEQ ID NO: 468 - protein, 241 aa, Artificial Sequence; identical to SEQ ID NO: 11
  synthesized

SEQ ID NO: 469 - protein, 241 aa, Artificial Sequence
  synthesized
QVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSGGGGSGGGGSGGGGSEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIK

SEQ ID NO: 470 - protein, 243 aa, Artificial Sequence
  synthesized
QSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSS

SEQ ID NO: 471 - protein, 243 aa, Artificial Sequence
  synthesized
EVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSSGGGGSGGGGSGGGGSQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVL

SEQ ID NO: 472 - protein, 236 aa, Artificial Sequence
  synthesized
SIVMTQSPATLSVTPGDRVSLSCRASQSIGDYLHWFQQKSHESPRLLIKYASQSISGIPSRFSGSGSGSDFTLIINTMEPEDVGVYYCQNAHTYPYTFGGGTKLEIKGGGGSGGGGSGGGGSQVKLQQSGPELVRPGASVKMSCKASGYTFTTYWMHWVKQRPGQGLEWIGMIDPSNSDTRLNQKFKDKATLNVDTSSNTAYMHLSSLTSEDSAVYYCTLGGTEYWGQGATLTVSS

SEQ ID NO: 473 - protein, 236 aa, Artificial Sequence
  synthesized
QVKLQQSGPELVRPGASVKMSCKASGYTFTTYWMHWVKQRPGQGLEWIGMIDPSNSDTRLNQKFKDKATLNVDTSSNTAYMHLSSLTSEDSAVYYCTLGGTEYWGQGATLTVSSGGGGSGGGGSGGGGSSIVMTQSPATLSVTPGDRVSLSCRASQSIGDYLHWFQQKSHESPRLLIKYASQSISGIPSRFSGSGSGSDFTLIINTMEPEDVGVYYCQNAHTYPYTFGGGTKLEIK

SEQ ID NO: 474 - protein, 242 aa, Artificial Sequence
  synthesized
SIVMTQTPLTLSVTIGQPASISCKSSQSLLYSDGQTYLNWLLQRPGQSPKRLIYLVSKLDSGVPDRFTGSGSGTDFTLKISRVEAEDLGVYYCVQTTHFPYTFGGGTKLEMKGGGGSGGGGSGGGGSQVQLKESGGGLVQPGESLKLSCESSEFPFPSHDMSWVRKTPEKRLELVAAINSDGGSTYYPDTMERRFIISRDNTKKTLYLQMSSLRSEDTALYYCASLPTFAYWGQGTLVTVSA

SEQ ID NO: 475 - protein, 242 aa, Artificial Sequence
  synthesized
QVQLKESGGGLVQPGESLKLSCESSEFPFPSHDMSWVRKTPEKRLELVAAINSDGGSTYYPDTMERRFIISRDNTKKTLYLQMSSLRSEDTALYYCASLPTFAYWGQGTLVTVSAGGGGSGGGGSGGGGSSIVMTQTPLTLSVTIGQPASISCKSSQSLLYSDGQTYLNWLLQRPGQSPKRLIYLVSKLDSGVPDRFTGSGSGTDFTLKISRVEAEDLGVYYCVQTTHFPYTFGGGTKLEMK

SEQ ID NO: 476 - protein, 237 aa, Artificial Sequence
  synthesized
DIVMTQSHKFMSTSVGDRVSIICKASQDVGTAVDWYQQKPGQSPKLLIYWASTRHTGVPDRFTGSGSGTDFTLAITNVQSEDLADYFCQQYNSYPLTFGAGTKLEIKGGGGSGGGGSGGGGSEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTLTVSS

SEQ ID NO: 477 - protein, 237 aa, Artificial Sequence
  synthesized
EVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTLTVSSGGGGSGGGGSGGGGSDIVMTQSHKFMSTSVGDRVSIICKASQDVGTAVDWYQQKPGQSPKLLIYWASTRHTGVPDRFTGSGSGTDFTLAITNVQSEDLADYFCQQYNSYPLTFGAGTKLEIK

SEQ ID NO: 478 - protein, 245 aa, Artificial Sequence
  Synthesized
DIQMTRAPDSLSASVGDRVTITCRASQGVDIYVAWYQQKPGKAPKLLMHSASTLASGVPSRFSGRGSGTDFTLTINSLQAEDVATYYCQSHNSAVVTFGQGTRLEIKGGGGSGGGGSGGGGSEVQLLESGGGLVQPGGSLRLSCAASGFTFSRYVMVWVRQAPGKGLDWVSGISPSGGVTRYADSVKGRFTISRDNSKNTLYLQMNSLRAEDTAMYYCARIRKEMTTISYFFDYWGQGTLVTVSS

SEQ ID NO: 479 - protein, 246 aa, Artificial Sequence
  Synthesized
QIVLTQSPAIMSASLGERVTMTCTASSSVNSFYLHWYQQKPGSSPKLWIHSTSNLASGVPGRFSGSGSGTSYSLTISSMEAEDAATYYCHQYHRSPYTFGGGTKLEIKGGGGSGGGGSGGGGSQVQLQQSGAELMKPGASVKISCKATGYTFSSYWIEWVKQRPGHGLEWIGEILPGSGNTYYNERFKDKATFTADTSSNTAYMQLSSLTSEDSAVYYCARRAAAYYSNPEWFAYWGQGTLVTVSA

SEQ ID NO: 480 - DNA, 9780 bp, Artificial Sequence
  Synthesized
cggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtcgactctagaactagtaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgccgcggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagccatattcaacgggaaacgtcttgctctaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctggctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgatcacgagactagcctcgacacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttatcgacttaacttgtttattgcagcttataatggttacaaataaggcaatagcatcacaaatttcacaaataaggcatttttttcactgcattctagttttggtttgtccaaactcatcaatgtatcttatcatgtctggatctcaaatccctcggaagctgcgcctgtcttaggttggagtgatacatttttatcacttttacccgtctttggattaggcagtagctctgacggccctcctgtcttaggttagtgaaaaatgtcactctcttacccgtcattggctgtccagcttagctcgcaggggaggtggtcttcattactggctagctcttctgcctctaaacagcatctggctcctcttcctcttgccggttttagcagcggggctcagttcggccatcacttggatcagctcgtggatggcctttctctggacgttcagatcggtcacggagtagttggtgagcttctcgaagtcgtccctcttcttcttgttgctgttgaagaatttcacgttcatatcctccttgatggtctcgacgctcttctggatgctctggtcgtccttgaagttcttgaagagcttgaagtagaagctcacgatctgggactgcatgatctttctatcggactcctccttccagttcttcagaatgccgagaaacagtgtgccgttatcggccacgtcggagtggccggcattgaagtacttcttgaggttctcggcctccttcacgtaggggtcttggcagtagcagcccagagagcccagcacgatgcacagctggaaggccagaatgtagctggtgtacttcatggggccggggttctcctcgacatctccggcttgcttcagcagagagaaattggtggcgccgctgcccatttgccgaagagccctcaggctggactgcaggaactccttaaagctgcgcagaatgagatgagttgtcatgtcctgcagccactggttctgtgcctgcagcttcgtcagcaggctggcatttgtggttgggtcaggggtggttattgcatctagattctttgcctttttctgcaggaactggatcaggacttttgtactcatctgcacagctctggcttgttcctcactactctcaaatctgttctggaggtactctaggtatacctcaaactccaaaagaccagtgatgattttcaccaggcaagtctcctcattgaatccagattggaagcatccatctttttcagccatctttggaaggttcaggttgttttctgccagtgcctctttgctgctttcacacatgttactcttgttacatgtctcctttctcagggctgagatgccgtcgaggatgtaccgaatttgtttgtcaattcgttctgaagaggtgagtggctgtctgtgtggggcggctacatctttggaatcttctcctgggggtactggggcagggaaggcagcaggcaacaccaggagcagccccagggagaaggcaactggaccgaaggcgcttgtggagaaggagttcatggtggccaggagttgaggttactgtgagtagtgattaaagagagtgatagggaactcttgaacaagagatgcaatttatactgttaattctggaaaaatattatgggggtgtcaaaatgtcccgggaccaattgacgccttctgtatgaaacagtttttcctcctaattgacgccttctgtatgaaacagtttttcctcctaattgacgccttctgtatgaaacagtttttcctcctaattcgatgggaccaattgacgccttctgtatgaaacagtttttcctcctaattgacgccttctgtatgaaacagtttttcctcctaattgacgccttctgtatgaaacagtttttcctcctaattcgatatcaagcttatcgataccgtcgacctcgatgaattcgctagcaaatccactttggctcga

SEQ ID NO: 481 - DNA, 390 bp, Artificial Sequence
  Synthesized
tcgaggtcgacggtatcgataagcttgatatcgaattaggaggaaaaactgtttcatacagaaggcgtcaattaggaggaaaaactgtttcatacagaaggcgtcaattaggaggaaaaactgtttcatacagaaggcgtcaattggtcccatcgaattaggaggaaaaactgtttcatacagaaggcgtcaattaggaggaaaaactgtttcatacagaaggcgtcaattaggaggaaaaactgtttcatacagaaggcgtcaattggtcccgggacattttgacacccccataatatttttccagaattaacagtataaattgcatctcttgttcaagagttccctatcactctctttaatcactactcacagtaacctcaactcctg

SEQ ID NO: 482 - protein, 212 aa, Homo sapiens
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 483 - DNA, 57 bp, Homo sapiens
gccacgaacttctctctgttaaagcaagcaggagacgtggaagaaaaccccggtcct

SEQ ID NO: 484 - protein, 326 aa, Homo sapiens
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 485 - DNA, 10436 bp, Artificial Sequence
  Synthesized
cggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtcgactctagaactagtaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgccgcggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagccatattcaacgggaaacgtcttgctctaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctggctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgatcacgagactagcctcgacacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttatcgacttaacttgtttattgcagcttataatggttacaaataaggcaatagcatcacaaatttcacaaataaggcatttttttcactgcattctagttttggtttgtccaaactcatcaatgtatcttatcatgtctggatctcaaatccctcggaagctgcgcctgtcttaggttggagtgatacatttttatcacttttacccgtctttggattaggcagtagctctgacggccctcctgtcttaggttagtgaaaaatgtcactctcttacccgtcattggctgtccagcttagctcgcaggggaggtggtctcagtcgttggagccgaagtccagagagatgatggtgtctccagcggcgggggccagcagtgtcagagcatcgggctccttcttcagcttgtcaaacagagagctggtgtcctcgctctccaccttggtgaagagctgggtcatcttcatgtcgctgctctccacgggcttcagcacgcactcggtctgctgcagagagaagatcagatcgtgctggatgattcctctggcagcggcctctctagcagcggcttcgctggcgttcaggtagctcatcacccggtcgatggtcacggcccggatccggaaggcatgcaggaggatgcacagcttgatcttggtcttgtagaagtcgggctcttccaggctggacttctggggcactgtctcgctgttgaagttcagggcctgcatcagctcgtcgatcacggccagcatgttctgatccaggaagatctgccgcttggggtccatcagcagcttggcgttcatggtcttgaactccacctggtacatcttcaggtcctcgtagatgctgctcaggcacagggccatcatgaagctggtctttctgctggccaggcaagagccgttggtgatgaagcttgtctcccgagagttcagacagctctcgttcttggtcagttccaggggcaggcaggcctccacggtgctggtcttatccttggtgatgtcctcgtggtcgatttcctcgctggtgcaggggtagaattccagggtctgccgggccttctgcagcatgttgctcacggcccgcagcaggttctggctgtggtgcaggcaggggaacatgccggggtcgggggtagccacgggcaggttccggcttcctccgccccctccgccgctgcagggcacgctggcccactcggaccaggagctgctgtagtaccggtcctgggcccgcacgctgatgctggcgttcttccggcagatcacggtggcgctggtcttgtcggtgaacacccggtctttcttctcccgcttgctcttgccctgcacctgcacacagaaggtcaggctgaagtagctgtggggggtggaccaggtgtcagggtactcccaggacacctccacctgccggctgttcttcaggggcttcagctgcaggttcttgggggggtcgggcttgatgatgtcccggatgaaaaagctggaggtgtagttctcgtacttcagcttgtgcacggcgtccaccatcacctcgatgggcaggctttcctcggcggcagggcaggcgctatcttcctggcactcgacgctgtactcgtactctttgttgtcgccccgcactctctcggcgctcagggtggcggctccgcaggtcacgccctgagggtcgctgctgccccggctgctcttcacgctgaaggtcaggtcggtgctgatggtggtcagccaccaacaggtgaaccggccgctgtagttcttggcctcgcaccgcaggaaggtcttgttcttgggctctttctggtccttcaggatgtcggtggaccagatgccatcctctttcttgtgcagcagcagcaggctgtgggacagcacttcgccgcccttgtggcaggtgtactggccggcgtcgccgaactctttgacctggatggtcagggtcttgccgctgcccagcacctcgctgctctggtccagggtccaggtgatgccgtcctcttcgggggtgtcgcaggtcagcaccaccatctcgccaggggcgtcgggataccagtccagctccaccacgtacacgtctttcttcagctcccagatggccaccagggggctggccaggaacaccaggctgaaccagctgatgaccagctgctgatgacacatggtggccaggagttgaggttactgtgagtagtgattaaagagagtgatagggaactcttgaacaagagatgcaatttatactgttaattctggaaaaatattatgggggtgtcaaaatgtcccgggaccaattgacgccttctgtatgaaacagtttttcctcctaattgacgccttctgtatgaaacagtttttcctcctaattgacgccttctgtatgaaacagtttttcctcctaattcgatgggaccaattgacgccttctgtatgaaacagtttttcctcctaattgacgccttctgtatgaaacagtttttcctcctaattgacgccttctgtatgaaacagtttttcctcctaattcgatatcaagcttatcgataccgtcgacctcgatgaattcgctagcaaatccactttggctcgagaagcttgatat

SEQ ID NO: 486 - protein, 219 aa, Homo sapiens
MCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 487 - protein, 74 aa, Artificial Sequence
  Synthesized
GIIQHDLIFSLQQTECVLKPVESSDMKMTQLFTKVESEDTSSLFDKLKKEPDALTLLAPAAGDTIISLDFGSND

SEQ ID NO: 488 - protein, 485 aa, Artificial Sequence
  Synthesized
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSAKPTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 489 - protein, 264 aa, Artificial Sequence
  Synthesized
MALPVTALLLPLALLLHAARPQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSS

SEQ ID NO: 490 - protein, 267 aa, Artificial Sequence
  Synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSS

SEQ ID NO: 491 - protein, 264 aa, Artificial Sequence; identical to SEQ ID NO: 489
  Synthesized

SEQ ID NO: 492 - protein, 754 aa, Artificial Sequence; identical to SEQ ID NO: 454
  Synthesized

SEQ ID NO: 493 - protein, 753 aa, Artificial Sequence
  Synthesized
MALPVTALLLPLALLLHAARPQSVLTQPPSVSAAPGQKVTISCSGSSSDIGSNYVSWYQQFPGTAPKLLIYDNNKRPSAIPDRFSGSKSGTSATLGITGLQTGDEADYYCGTWDSRLGIAVFGGGTQLTVLGGGGGSGGGGSGGGGSEVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 494 - protein, 753 aa, Artificial Sequence
  Synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQSVLTQPPSVSAAPGQKVTISCSGSSSDIGSNYVSWYQQFPGTAPKLLIYDNNKRPSAIPDRFSGSKSGTSATLGITGLQTGDEADYYCGTWDSRLGIAVFGGGTQLTVLGGGGGSGGGGSGGGGSEVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 495 - protein, 750 aa, Artificial Sequence
  Synthesized
MALPVTALLLPLALLLHAARPQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 496 - protein, 750 aa, Artificial Sequence
  Synthesized
MALPVTALLLPLALLLHAARPQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSSGGGGSGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 497 - protein, 750 aa, Artificial Sequence
  Synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 498 - protein, 750 aa, Artificial Sequence
  Synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSSGGGGSGGGGSGGGGSQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 499 - protein, 265 aa, Artificial Sequence
  Synthesized
MSPAQFLFLLVLWIQETNGDVVMTQTPLTLSVTIGQPASISCKSSQSLLYSNGKTYLNWLLQRPGQSPKRLIYLVSKLDSGVPDRFTGSGSGTDFTLKISRVEAEDLGVYYCVQGTHFPHTFGGGTKLEIKRMNFGLSLIFLVLVLKGVQCEVKVVESGGGLVKPGASLKLSCAASGFTFSNYGMSWVRQTSDKRLEWVASISSGGDSTFYADNVKGRFTISRENAKNTLYLQMSSLKSEDTALYYCARDDLFNWGQGTTLTVSS

SEQ ID NO: 500 - protein, 254 aa, Artificial Sequence
  Synthesized
VTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGILGSGGGGSGGGGSGGGGSQPVLTQSSSLSASPGASASLYHRCTLRSGINVGPYRIYWYQQSYSPGSPPQYLLNYKSDSDKQQGSGVPSRFSGSKDASANAGVLLISGLRSEDEADYYCMIWHSSAAVFGGGTQLTVLSAS

SEQ ID NO: 501 - protein, 262 aa, Artificial Sequence
  Synthesized
MVLLVTSLLLCELPHPAFLLIPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSS

SEQ ID NO: 502 - protein, 263 aa, Artificial Sequence
  Synthesized
MGWSCIILFLVATATGVHSDIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIKRGGSGSGGSGSGGSGSEVQLVESGGGVVQPGRSLRLSCSASGFDFTTYWMSWVRQAPGKGLEWIGEIHPDSSTINYAPSLKDRFTISRDNAKNTLFLQMDSLRPEDTGVYFCASLYFGFPWFAYWGQGTPVTVSSAKP

SEQ ID NO: 503 - protein, 311 aa, Artificial Sequence
  Synthesized
DVVMTQSPLSLPVTPGEPASISCRSSQSLVHSNANTYLHWYLQKPGQSPQLLIYKVSNRFSGVPDRFSGSGSGTDFTLKISRVGAGDVGVYYCSQNTHVPPTFGQGTKLEIKRGGGGSGGGGSGGGGSQVQLVQSGAEVKKPGASVKVSCKASGYTFTDYEMHWVRQAPGQGLEWMGALDPKTGDTAYSQKFKGRVTLTADESTSTAYMELSSLRSEDTAVYYCTRFYSYTYWGQGTLVTVSSTTTPAPRPPTPAPTIASQPLSLRPEACRPAAGGAVHTRGLDFALECDFWVLVVVGGVLACYSLLVTVA

SEQ ID NO: 504 - protein, 343 aa, Artificial Sequence
  Synthesized
GPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPAPEFEGGPSVFLFPPKPKDTLMISRTPEVTCVVVAKDVSQEDPEVQFNWYVDVVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 505 - DNA, 1803 bp, Artificial Sequence
  Synthesized
tcgaggtcgacggtatcgataagcttgatatcgaattaggaggaaaaactgtttcatacagaaggcgtcaattaggaggaaaaactgtttcatacagaaggcgtcaattaggaggaaaaactgtttcatacagaaggcgtcaattggtcccatcgaattaggaggaaaaactgtttcatacagaaggcgtcaattaggaggaaaaactgtttcatacagaaggcgtcaattaggaggaaaaactgtttcatacagaaggcgtcaattggtcccgggacattttgacacccccataatatttttccagaattaacagtataaattgcatctcttgttcaagagttccctatcactctctttaatcactactcacagtaacctcaactcctggccaccatgtttcacgtcagctttagatacatcttcggactgcctcctctgattctcgtgctgctgcccgtggcttccagcgactgcgacatcgagggcaaggacggcaagcagtacgagtccgtgctgatggtcagcatcgaccaactgctcgatagcatgaaggagatcggcagcaactgcctcaataacgagttcaacttcttcaagaggcacatctgcgacgccaacaaggagggcatgtttctgttcagagccgccagaaagctgaggcagtttctgaagatgaactccaccggcgactttgatctgcatctgctgaaagtgagcgagggcaccaccattctgctgaattgcaccggccaagtgaagggcagaaaacccgccgccctcggcgaagcccaacccaccaaatctctggaggagaacaagtctctgaaggagcagaagaagctgaacgatctgtgctttctgaaaaggctgctccaagagatcaagacatgctggaacaagatcctcatgggcaccaaggaacacgaagccgctgctagagaggccgctgccagaggaatcatccagcacgatctgatcttctctctgcagcagaccgagtgcgtgctgaagcccgtggagagcagcgacatgaagatgacccagctcttcaccaaggtggagagcgaggacaccagctctctgtttgacaagctgaagaaggagcccgatgctctgacactgctggcccccgccgctggagacaccatcatctctctggacttcggctccaacgacggctccggcgtgaagcagaccctcaacttcgatctgctgaagctggctggcgacgtggagtccaaccccggccccatggctctgctgctggctctgtctctgctggtgctgtggacaagccccgcccccacactgagcggcaccaatgacgccgaggactgctgtctgagcgtgacccagaagcctatccccggctacatcgtgaggaacttccactatctgctgatcaaggacggctgtagagtgcccgccgtggtgttcacaacactgagaggcagacagctctgtgcccctcccgaccagccttgggtggaaaggatcattcagaggctgcagaggacctccgccaaaatgaagagaaggagcagcgaagccgctgctagagaggccgctgccagaggaatcatccagcacgatctgatcttctctctgcagcagaccgagtgcgtgctgaagcccgtggagagcagcgacatgaagatgacccagctcttcaccaaggtggagagcgaggacaccagctctctgtttgacaagctgaagaaggagcccgatgctctgacactgctggcccccgccgctggagacaccatcatctctctggacttcggctccaacgactga

SEQ ID NO: 506 - DNA, 1803 bp, Artificial Sequence
  Synthesized
tcgaggtcgacggtatcgataagcttgatatcgaattaggaggaaaaactgtttcatacagaaggcgtcaattaggaggaaaaactgtttcatacagaaggcgtcaattaggaggaaaaactgtttcatacagaaggcgtcaattggtcccatcgaattaggaggaaaaactgtttcatacagaaggcgtcaattaggaggaaaaactgtttcatacagaaggcgtcaattaggaggaaaaactgtttcatacagaaggcgtcaattggtcccgggacattttgacacccccataatatttttccagaattaacagtataaattgcatctcttgttcaagagttccctatcactctctttaatcactactcacagtaacctcaactcctggccaccatggctctgctgctggctctgtctctgctggtgctgtggacaagccccgcccccacactgagcggcaccaatgacgccgaggactgctgtctgagcgtgacccagaagcctatccccggctacatcgtgaggaacttccactatctgctgatcaaggacggctgtagagtgcccgccgtggtgttcacaacactgagaggcagacagctctgtgcccctcccgaccagccttgggtggaaaggatcattcagaggctgcagaggacctccgccaaaatgaagagaaggagcagcgaagccgctgctagagaggccgctgccagaggaatcatccagcacgatctgatcttctctctgcagcagaccgagtgcgtgctgaagcccgtggagagcagcgacatgaagatgacccagctcttcaccaaggtggagagcgaggacaccagctctctgtttgacaagctgaagaaggagcccgatgctctgacactgctggcccccgccgctggagacaccatcatctctctggacttcggctccaacgacggctccggcgtgaagcagaccctcaacttcgatctgctgaagctggctggcgacgtggagtccaaccccggccccatgtttcacgtcagctttagatacatcttcggactgcctcctctgattctcgtgctgctgcccgtggcttccagcgactgcgacatcgagggcaaggacggcaagcagtacgagtccgtgctgatggtcagcatcgaccaactgctcgatagcatgaaggagatcggcagcaactgcctcaataacgagttcaacttcttcaagaggcacatctgcgacgccaacaaggagggcatgtttctgttcagagccgccagaaagctgaggcagtttctgaagatgaactccaccggcgactttgatctgcatctgctgaaagtgagcgagggcaccaccattctgctgaattgcaccggccaagtgaagggcagaaaacccgccgccctcggcgaagcccaacccaccaaatctctggaggagaacaagtctctgaaggagcagaagaagctgaacgatctgtgctttctgaaaaggctgctccaagagatcaagacatgctggaacaagatcctcatgggcaccaaggaacacgaagccgctgctagagaggccgctgccagaggaatcatccagcacgatctgatcttctctctgcagcagaccgagtgcgtgctgaagcccgtggagagcagcgacatgaagatgacccagctcttcaccaaggtggagagcgaggacaccagctctctgtttgacaagctgaagaaggagcccgatgctctgacactgctggcccccgccgctggagacaccatcatctctctggacttcggctccaacgactga

SEQ ID NO: 507 - DNA, 1461 bp, Artificial Sequence
  Synthesized
atggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 508 - DNA, 277 bp, Artificial Sequence
  Synthesized
tcgaggtcgacggtatcgataagcttgatatcgaattaggaggaaaaactgtttcatacagaaggcgtcaattaggaggaaaaactgtttcatacagaaggcgtcaattaggaggaaaaactgtttcatacagaaggcgtcaattggtcccatcgaattaggaggaaaaactgtttcatacagaaggcgtcaattaggaggaaaaactgtttcatacagaaggcgtcaattaggaggaaaaactgtttcatacagaaggcgtcaattggtcccggga

SEQ ID NO: 509 - DNA, 531 bp, Homo sapiens
atgtttcacgtcagctttagatacatcttcggactgcctcctctgattctcgtgctgctgcccgtggcttccagcgactgcgacatcgagggcaaggacggcaagcagtacgagtccgtgctgatggtcagcatcgaccaactgctcgatagcatgaaggagatcggcagcaactgcctcaataacgagttcaacttcttcaagaggcacatctgcgacgccaacaaggagggcatgtttctgttcagagccgccagaaagctgaggcagtttctgaagatgaactccaccggcgactttgatctgcatctgctgaaagtgagcgagggcaccaccattctgctgaattgcaccggccaagtgaagggcagaaaacccgccgccctcggcgaagcccaacccaccaaatctctggaggagaacaagtctctgaaggagcagaagaagctgaacgatctgtgctttctgaaaaggctgctccaagagatcaagacatgctggaacaagatcctcatgggcaccaaggaacac

SEQ ID NO: 510 - DNA, 294 bp, Homo sapiens
atggctctgctgctggctctgtctctgctggtgctgtggacaagccccgcccccacactgagcggcaccaatgacgccgaggactgctgtctgagcgtgacccagaagcctatccccggctacatcgtgaggaacttccactatctgctgatcaaggacggctgtagagtgcccgccgtggtgttcacaacactgagaggcagacagctctgtgcccctcccgaccagccttgggtggaaaggatcattcagaggctgcagaggacctccgccaaaatgaagagaaggagcagc

SEQ ID NO: 511 - DNA, 255 bp, Artificial Sequence
  Synthesized
gaagccgctgctagagaggccgctgccagaggaatcatccagcacgatctgatcttctctctgcagcagaccgagtgcgtgctgaagcccgtggagagcagcgacatgaagatgacccagctcttcaccaaggtggagagcgaggacaccagctctctgtttgacaagctgaagaaggagcccgatgctctgacactgctggcccccgccgctggagacaccatcatctctctggacttcggctccaacgactga

SEQ ID NO: 512 - DNA, 75 bp, Artificial Sequence
  Synthesized
ggctccggcgtgaagcagaccctcaacttcgatctgctgaagctggctggcgacgtggagtccaaccccggcccc

SEQ ID NO: 513 - protein, 241 aa, Artificial Sequence
  Synthesized
DVQMTQSPSSLSASVGDRVTITCRASQSISDYLSWYQQRPGKAPNLLIYAASNLKTGVPSRFSGSGSGTDFTLTISTLQPEDFATYYCQQSYRSPWTFGQGTKVEIKGGGGSGGGGSGGGGSEVQLVESGGGLVKPGGSLRLSCAASGFTYSNAWMSWVRQAPGKGLEWVGRIKSKTDGGTTDYAAPVQGRFTISRDDSKNTLYLQMNSLKTEDTAVYYCTIFGVVSFDYWGQGTLVTVSS

SEQ ID NO: 514 - DNA, 552 bp, Homo sapiens
atggcacccctgctgcccatccggaccttgcccttgatcctgattctgctggctctgctgtccccaggggctgcagacttcaacatctcaagcctctctggtctgctgtccccggcgctaacggagagcctgctggttgccttgcccccctgtcacctcacaggaggcaatgccacactgatggtccggagagccaatgacagcaaagtggtgacgtccagctttgtggtgcctccgtgccgtgggcgcagggaactggtgagtgtggtggacagtggtgctggcttcacagtcactcggctcagtgcataccaggtgacaaacctcgtgccaggaaccaaattctacatttcctacctagtgaagaaggggacagccactgagtccagcagagagatcccaatgtccacactccctcgaaggaacatggaatccattgggctgggtatggcccgcacagggggcatggtggtcatcacggtgctgctctctgtcgccatgttcctgctggtgctgggcttcatcattgccctggcactgggctcccgcaag

SEQ ID NO: 515 - protein, 487 aa, Artificial Sequence
  Synthesized
MALPVTALLLPLALLLHAARPQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 516 - protein, 486 aa, Artificial Sequence
  Synthesized
MALPVTALLLPLALLLHAARPQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 517 - protein, 512 aa, Artificial Sequence
  Synthesized
MALPVTALLLPLALLLHAARPQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRRKRGSGEGRGSLLTCGDVEENPGP

SEQ ID NO: 518 - protein, 669 aa, Artificial Sequence
  Synthesized
MGTSLLCWMALCLLGADHADACPYSNPSLCSGGGGSELPTQGTFSNVSTNVSPAKPTTTACPYSNPSLCSGGGGSPAPRPPTPAPTIASQPLSLRPEACRPAAGGAVHTRGLDFACDIYIWAPLAGTCGVLLLSLVITLYCNHRNRRRVCKCPRPVVRRKRGSGEGRGSLLTCGDVEENPGPMALPVTALLLPLALLLHAARPQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 519 - protein, 668 aa, Artificial Sequence
  Synthesized
MALPVTALLLPLALLLHAARPQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRRKRGSGEGRGSLLTCGDVEENPGPMGTSLLCWMALCLLGADHADACPYSNPSLCSGGGGSELPTQGTFSNVSTNVSPAKPTTTACPYSNPSLCSGGGGSPAPRPPTPAPTIASQPLSLRPEACRPAAGGAVHTRGLDFACDIYIWAPLAGTCGVLLLSLVITLYCNHRNRRRVCKCPRPVV

SEQ ID NO: 520 - protein, 668 aa, Artificial Sequence
  Synthesized
MGTSLLCWMALCLLGADHADACPYSNPSLCSGGGGSELPTQGTFSNVSTNVSPAKPTTTACPYSNPSLCSGGGGSPAPRPPTPAPTIASQPLSLRPEACRPAAGGAVHTRGLDFACDIYIWAPLAGTCGVLLLSLVITLYCNHRNRRRVCKCPRPVVRRKRGSGEGRGSLLTCGDVEENPGPMALPVTALLLPLALLLHAARPQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 521 - protein, 119 aa, Artificial Sequence
  Synthesized
EVQLVESGGGLVKPGGSLRLSCAASGFTYSNAWMSWVRQAPGKGLEWVGRIKSKTDGGTTDYAAPVQGRFTISRDDSKNTLYLQMNSLKTEDTAVYYCTIFGVVSFDYWGQGTLVTVSS

SEQ ID NO: 522 - protein, 241 aa, Artificial Sequence
  Synthesized
EVQLVESGGGLVKPGGSLRLSCAASGFTYSNAWMSWVRQAPGKGLEWVGRIKSKTDGGTTDYAAPVQGRFTISRDDSKNTLYLQMNSLKTEDTAVYYCTIFGVVSFDYWGQGTLVTVSSGGGGSGGGGSGGGGSDVQMTQSPSSLSASVGDRVTITCRASQSISDYLSWYQQRPGKAPNLLIYAASNLKTGVPSRFSGSGSGTDFTLTISTLQPEDFATYYCQQSYRSPWTFGQGTKVEIK

SEQ ID NO: 523 - protein, 464 aa, Artificial Sequence
  Synthesized
EVQLVESGGGLVKPGGSLRLSCAASGFTYSNAWMSWVRQAPGKGLEWVGRIKSKTDGGTTDYAAPVQGRFTISRDDSKNTLYLQMNSLKTEDTAVYYCTIFGVVSFDYWGQGTLVTVSSGGGGSGGGGSGGGGSDVQMTQSPSSLSASVGDRVTITCRASQSISDYLSWYQQRPGKAPNLLIYAASNLKTGVPSRFSGSGSGTDFTLTISTLQPEDFATYYCQQSYRSPWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 524 - protein, 532 aa, Artificial Sequence
  Synthesized
EVQLVESGGGLVKPGGSLRLSCAASGFTYSNAWMSWVRQAPGKGLEWVGRIKSKTDGGTTDYAAPVQGRFTISRDDSKNTLYLQMNSLKTEDTAVYYCTIFGVVSFDYWGQGTLVTVSSGGGGSGGGGSGGGGSDVQMTQSPSSLSASVGDRVTITCRASQSISDYLSWYQQRPGKAPNLLIYAASNLKTGVPSRFSGSGSGTDFTLTISTLQPEDFATYYCQQSYRSPWTFGQGTKVEIKTTTPAPRPPTPAPTIASQPLSLRPEACRPAAGGAVHTRGLDFACDIYIWAPLAGTCGVLLLSLVITLYCAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 525 - protein, 133 aa, Artificial Sequence
  Synthesized
APASSSTKKTQLQLEHLLLDLQMILNGINNYKNPKLTRMLTAKFAMPKKATELKHLQCLEEELKPLEEVLNGAQSKNFHLRPRDLISNINVIVLELKGSETTFMCEYADETATIVEFLNRWITFAQSIISTLT

SEQ ID NO: 526 - protein, 107 aa, Artificial Sequence
  Synthesized
DVQMTQSPSSLSASVGDRVTITCRASQSISDYLSWYQQRPGKAPNLLIYAASNLKTGVPSRFSGSGSGTDFTLTISTLQPEDFATYYCQQSYRSPWTFGQGTKVEIK

SEQ ID NO: 527 - protein, 207 aa, Homo sapiens
MAGPATQSPMKLMALQLLLWHSALWTVQEATPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 528 - protein, 480 aa, Artificial Sequence
  Synthesized
MALPVTALLLPLALLLHAARPQVKLQQSGPELVRPGASVKMSCKASGYTFTTYWMHWVKQRPGQGLEWIGMIDPSNSDTRLNQKFKDKATLNVDTSSNTAYMHLSSLTSEDSAVYYCTLGGTEYWGQGATLTVSSGGGGSGGGGSGGGGSSIVMTQSPATLSVTPGDRVSLSCRASQSIGDYLHWFQQKSHESPRLLIKYASQSISGIPSRFSGSGSGSDFTLIINTMEPEDVGVYYCQNAHTYPYTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 529 - protein, 479 aa, Artificial Sequence
  Synthesized
MALPVTALLLPLALLLHAARPQVKLQQSGPELVRPGASVKMSCKASGYTFTTYWMHWVKQRPGQGLEWIGMIDPSNSDTRLNQKFKDKATLNVDTSSNTAYMHLSSLTSEDSAVYYCTLGGTEYWGQGATLTVSSGGGGSGGGGSGGGGSSIVMTQSPATLSVTPGDRVSLSCRASQSIGDYLHWFQQKSHESPRLLIKYASQSISGIPSRFSGSGSGSDFTLIINTMEPEDVGVYYCQNAHTYPYTFGGGTKLEIKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 530 - protein, 486 aa, Artificial Sequence
  Synthesized
MALPVTALLLPLALLLHAARPQVQLKESGGGLVQPGESLKLSCESSEFPFPSHDMSWVRKTPEKRLELVAAINSDGGSTYYPDTMERRFIISRDNTKKTLYLQMSSLRSEDTALYYCASLPTFAYWGQGTLVTVSAGGGGSGGGGSGGGGSSIVMTQTPLTLSVTIGQPASISCKSSQSLLYSDGQTYLNWLLQRPGQSPKRLIYLVSKLDSGVPDRFTGSGSGTDFTLKISRVEAEDLGVYYCVQTTHFPYTFGGGTKLEMKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 531 - protein, 485 aa, Artificial Sequence
  Synthesized
MALPVTALLLPLALLLHAARPQVQLKESGGGLVQPGESLKLSCESSEFPFPSHDMSWVRKTPEKRLELVAAINSDGGSTYYPDTMERRFIISRDNTKKTLYLQMSSLRSEDTALYYCASLPTFAYWGQGTLVTVSAGGGGSGGGGSGGGGSSIVMTQTPLTLSVTIGQPASISCKSSQSLLYSDGQTYLNWLLQRPGQSPKRLIYLVSKLDSGVPDRFTGSGSGTDFTLKISRVEAEDLGVYYCVQTTHFPYTFGGGTKLEMKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 532 - protein, 483 aa, Artificial Sequence
  Synthesized
MALPVTALLLPLALLLHAARPDIQMTQSPSSLSASVGDRVTITCRASQSVGSFLAWYQQKPGKAPKLLIYGASSRESGVPSRFSGSGSGTDFTLTISSLQPEDFATYYCQQTYHNPETFGQGTKVEIKGGGGSGGGGSGGGGSEVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 533 - protein, 488 aa, Artificial Sequence
  Synthesized
MALPVTALLLPLALLLHAARPEVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSGGGGSGGGGSGGGGSQSVLTQPPSVSAAPGQKVTISCSGSSSDIGSNYVSWYQQFPGTAPKLLIYDNNKRPSAIPDRFSGSKSGTSATLGITGLQTGDEADYYCGTWDSRLGIAVFGGGTQLTVLAKPTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 534 - protein, 489 aa, Artificial Sequence
  Synthesized
MALPVTALLLPLALLLHAARPDIVMTQSPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPWTFGGGTKLEMKGGGGSGGGGSGGGGSQVQLQQSGAELARPGASVKMSCKASGNTFTSYTMRWVKQGPGQGLEWIGYINPSSGYTNYNKKFKDKATLTADKSSSTAYMQLSSLTSDDSAVYYCVFGNPRYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

The invention claimed is:

1. A modified cell comprising a polynucleotide comprising a nucleotide sequence comprising a nuclear factor of activated T-cells (NFAT) promoter and comprising SEQ ID NO: 481, a nucleotide sequence encoding a therapeutic agent, and a nucleotide sequence encoding a VHL-interaction domain of hypoxia-inducible factor 1-alpha (HIF1α) and comprising SEQ ID NO: 511, wherein the nucleotide sequence encoding the therapeutic agent is flanked by the NFAT promoter and the nucleotide sequence encoding the VHL-interaction domain of HIF1α.

2. The modified cell of claim 1, wherein the modified cell comprises SEQ ID NO: 505 or 506.

3. The modified cell of claim 1, wherein the polynucleotide comprises SEQ ID NO: 527 that is flanked by SEQ ID NOS: 481 and 511.

4. The modified cell of claim 1, wherein the polynucleotide comprises a nucleotide sequence encoding SEQ ID NO: 486 that is flanked by SEQ ID NOS: 481 and 511.

5. The modified cell of claim 1, wherein the polynucleotide comprises a nucleotide sequence encoding SEQ ID NO: 482 that is flanked by SEQ ID NOS: 481 and 511.

6. The modified cell of claim 1, wherein the polynucleotide comprises SEQ ID NO: 509 that is flanked by SEQ ID NOS: 481 and 511.

7. The modified cell of claim 1, wherein the polynucleotide comprises SEQ ID NO: 510 that is flanked by SEQ ID NOS: 481 and 511.

8. The modified cell of claim 1, wherein the polynucleotide comprises a nucleotide sequence encoding SEQ ID NO: 525 that is flanked by SEQ ID NOS: 481 and 511.

9. The modified cell of claim 1, wherein the therapeutic agent comprises at least one of IL-12, IL-6, IL-7, IL-15, IL-23, IL-2, GCSF, CCL19, or GM-CSF.

10. The modified cell of claim 1, wherein the modified cell comprises a chimeric antigen receptor (CAR) or a modified TCR.

11. The modified cell of claim 10, wherein the CAR comprises an antigen-binding domain, a transmembrane domain, and an intracellular signaling domain.

12. The modified cell of claim 11, wherein the antigen-binding domain binds one or more of the following tumor antigens: GUCY2C (GCC), TSHR, CD19, CD123, CD22, CD30, CD171, CS-1, CLL-1, CD33, EGFRvIII, GD2, GD3, BCMA, Tn Ag, PSMA, ROR1, FLT3, FAP, TAG72, CD38, CD44v6, CEA, EPCAM, B7H3, KIT, IL-13Ra2, Mesothelin, IL-11Ra, PSCA, PRSS21, VEGFR2, Lewis Y, CD24, PDGFR-beta, SSEA-4, CD20, Folate receptor alpha, ERBB2 (Her2/neu), MUC1, EGFR, NCAM, Prostase, PAP, ELF2M, Ephrin B2, IGF-I receptor, CAIX, LMP2, gp100, bcr-abl, tyrosinase, EphA2, Fucosyl GM1, GM3, TGS5, HMWMAA, o-acetyl-GD2, Folate receptor beta, TEM1/CD248, TEM7R, CLDN6, GPRC5D, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, NY-ESO-1, LAGE-1a, MAGE-A1, legumain, HPV E6, E7, MAGE A1, ETV6-AML, sperm protein 17, XAGE1, Tie 2, MAD-CT-1, MAD-CT-2, Fos-related antigen 1, p53, p53 mutant, prostein, survivin, telomerase, PCTA-1 (Galectin 8), MelanA (MART1), Ras mutant, ML-IAP, ERG (TMPRSS2 ETS fusion gene), NA17, PAX3, Androgen receptor, Cyclin B1, MYCN, RhoC, TRP-2, CYP1B1, BORIS, SART3, PAX5, OY-TES1, LCK, AKAP-4, SSX2, RAGE-1, human telomerase reverse transcriptase (hTERT), RU1, RU2, intestinal carboxyl esterase, mut hsp70-2, CD79a, CD79b, CD72, LAIR1, FCAR, LILRA2, CD300LF, CLEC12A, BST2, EMR2, LY75, GPC3, FCRL5, or IGLL1.

13. The modified cell of claim 11, wherein the intracellular signaling domain comprises a co-stimulatory signaling domain comprising a functional signaling domain of at least one of CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, a ligand that specifically binds with CD83, CDS, ICAM-1, GITR, BAFFR, HVEM (LIGHTR), SLAMF7, NKp80 (KLRF1), CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, NKp44, NKp30, NKp46, and NKG2D.

14. The modified cell of claim 1, wherein the modified cell is an immune cell.

15. The modified cell of claim 1, wherein the modified cell is a T or NK cell.

16. The modified cell of claim 1, wherein the modified cell has a reduced expression of endogenous TRAC gene.

17. The modified cell of claim 1, wherein the modified cell is prepared from cells derived from a healthy donor or a subject having cancer.

18. A pharmaceutical composition comprising a population of the modified cells of claim 1.

19. A method of eliciting or enhancing T cell response in a subject having prostate cancer, treating a subject having prostate cancer, or enhancing cancer treatment of a subject having prostate cancer, the method comprising administering an effective amount of the pharmaceutical composition of claim 18 to the subject having prostate cancer, wherein the therapeutic agent comprises IL-12 comprising SEQ ID NO: 486, IL-6 comprising SEQ ID NO: 482, or IFN-γ comprising SEQ ID NO: 484.

20. The modified cell of claim 1, wherein the polynucleotide comprises a nucleotide sequence encoding SEQ ID NO: 484 that is flanked by SEQ ID NOS: 481 and 511.

* * * * *